United States Patent
Nguyen et al.

(10) Patent No.: US 7,732,667 B2
(45) Date of Patent: Jun. 8, 2010

(54) TRANSGENIC PLANTS AND PROGENY AND SEED THEREOF

(75) Inventors: Henry T. Nguyen, Columbia, MO (US); Joel A. Kreps, Encinitas, CA (US)

(73) Assignee: Syngenta Participations AG, Basel (CH)

( * ) Notice: Subject to any disclaimer, the term of this patent is extended or adjusted under 35 U.S.C. 154(b) by 134 days.

(21) Appl. No.: 10/928,992

(22) Filed: Aug. 27, 2004

(65) Prior Publication Data

US 2005/0097639 A1    May 5, 2005

Related U.S. Application Data

(60) Provisional application No. 60/498,183, filed on Aug. 27, 2003.

(51) Int. Cl.
  *C12N 15/82* (2006.01)
  *C12N 15/29* (2006.01)
  *A01H 5/00* (2006.01)

(52) U.S. Cl. ...................................... 800/298
(58) Field of Classification Search ....................... None
  See application file for complete search history.

(56) References Cited

U.S. PATENT DOCUMENTS 5,837,545 A * 11/1998 Guy et al. ................... 435/419
7,084,323 B1 * 8/2006 Sheen ......................... 800/289

OTHER PUBLICATIONS

Whisstock J.C. et al. Prediction of protein function from protein sequence and structure. Q Rev Biophys. Aug. 2003;36(3):307-40. Review.*

Kaye C. et al. Characterization of a gene for spinach CAP160 and expression of two spinach cold-acclimation proteins in tobacco. Plant Physiol. Apr. 1998;116(4):1367-77.*

Tamura T. et al. Osmotic stress tolerance of transgenic tobacco expressing a gene encoding a membrane-located receptor-like protein from tobacco plants. Plant Physiol. Feb. 2003;131(2):454-62.*

Van Camp W. et al. Enhancement of oxidative stress tolerance in transgenic tobacco plants overproducing Fe-superoxide dismutase in chloroplasts. Plant Physiol. Dec. 1996;112(4):1703-14.*

Alignment of SEQ ID No:52 with Sequence 2 of Guy et al. U.S. Patent No. 5,837,545, issued Nov. 1998.*

Whisstock J.C. et al. Prediction of protein function from protein sequence and structure. Q Rev Biophys. Aug. 2003;36(3):307-40. Review.*

Invitation to Pay Additional Fees corresponding to PCT Application No. PCT/US04/27935 dated Sep. 2, 2005.

Li et al., "Characterization of Calreticulin as a Phosphoprotein Interacting with Cold-Induced Protein Kinase in Rice", *Biol. Pharm. Bull.*, 26(2): 256-261, 2003.

Dubouzet et al., "OsDREB genes in rice, *Oryza sativa* L., encode transcription activators that function in drought-, high-salt- and cold-responsive expression", *The Plant Journal*, 33:751-763, 2003.

International Search Repot and Written Opinion corresponding to PCT Application No. PCT/US04/27935 dated Nov. 15, 2005.

* cited by examiner

*Primary Examiner*—Cynthia Collins
(74) *Attorney, Agent, or Firm*—Jenkins, Wilson, Taylor & Hunt, P.A.

(57) ABSTRACT

The present subject matter provides a method for enhancing the abiotic stress tolerance of a plant. Polynucleotides isolated from rice (*Oryza sativa*) and encoding polypeptides for abiotic stress tolerance are also described.

11 Claims, No Drawings

TRANSGENIC PLANTS AND PROGENY AND SEED THEREOF

CROSS REFERENCE TO RELATED APPLICATIONS

This application is based on and claims priority to U.S. Provisional Application Ser. No. 60/498,183, filed Aug. 27, 2003, which is herein incorporated by reference in its entirety.

TECHNICAL FIELD

The presently disclosed subject matter pertains to nucleic acid molecules isolated from *Oryza sativa* comprising nucleotide sequences that encode polypeptides for abiotic stress tolerance. The presently disclosed subject matter also relates to methods of using nucleic acid molecules and/or polypeptides from rice in transgenic plants to confer the desired agronomic traits, and to use such nucleic acids to assist germplasm enhancement by breeding.

Table of Abbreviations

ABA—abscisic acid
ADP—adenosine diphosphate
AMV—Alfalfa Mosaic Virus
ATCC—America Type Culture Collection
ATP—adenosine triphosphate
BiP—binding polypeptide
bp—basepair(s)
CAB—chlorophyll a/b binding
CaMV—cauliflower mosaic virus
cDNA—complementary DNA
CDPK—calcium-dependent protein kinase
cM—centimorgan(s)
CMV—cytomegalovirus
CoA—coenzyme A
ColE1—a synthetic *E. coli* origin of replication
cRNAs—complementary RNAs
DEAE—di-ethyl-amino-ethyl
DH—double haploid
DHFR—dihydrofolate reductase
dsRNA—double-stranded RNA
EDTA—ethylene diamine tetraacetic acid
ELISA—enzyme-linked immunosorbent assay
EMCV—encephalomyocarditis virus
EPSP—5-enol-pyruvyl shikimate-3-phosphate
ER—endoplasmic reticulum
EST—expressed sequence tag
FAD—flavin adenine dinucleotide
FMN—flavin mononucleotide
GS2—glutamine synthase 2
GSH—glutathione
GTP—guanosine triphosphate
GUS—-glucuronidase
HOADH—high osmotic adjusting double haploid
HSPs—high scoring sequence pairs
HSV—herpes simplex virus
kb—kilobase(s)
$k_{cat}$—catalytic constant
$K_m$—Michaelis Constant
LEA—late embryogenesis abundant
LOADH—low osmotic adjusting double haploid
MatDB—MIPS *Arabidopsis thaliana* Database
Mb—megabase(s)
MCMV—Maize Chlorotic Mottle Virus
MDMV—Maize Dwarf Mosaic Virus
MDS—moderate dehydration stress
MIPS—Munich Information Center for Protein Sequences
MPa—megapascal
MTL—metallothionein-like
NAD(P)—nicotinamide adenine dinucleotide (phosphate)
NaDS—sodium dodecyl sulfate
OA—osmotic adjustment
ORF—open reading frame
PCR—polymerase chain reaction
PEG—polyethylene glycol
PEPC—phosphoenol carboxylase
pgk—phosphoglycerate kinase
PMI—phosphomannose isomerase
Protox—protoporphyrinogen oxidase
PTGS—post-transcriptional gene silencing
QTL—quantitative trait locus/loci
RFLP—restriction fragment length polymorphism
RGP—Rice Genome Research Program
RNAi—RNA interference
RT-PCR—reverse transcription polymerase chain reaction
RUBISCO—ribulose-1,5-bisphosphate carboxylase/oxygenase
RWC—relative water content
SDS—severe dehydration stress
SELEX—Systematic Evolution of Ligands by Exponential Enrichment
Sf9—*Spodoptera frugiperda* cell line
SSC—standard saline citrate
TBE—tris-borate-EDTA
tk—thymidine kinase
TEV—Tobacco Etch Virus
TMTD—tetramethylthiuram disulfide
TMV—Tobacco Mosaic Virus
WW—well watered Amino Acid Abbreviations, Codes, and Functionally Equivalent Codons

| Amino Acid | 3-Letter | 1-Letter | Codons |
|---|---|---|---|
| Alanine | Ala | A | GCA; GCC; GCG; GCU |
| Arginine | Arg | R | AGA; AGG; CGA; CGC; CGG; CGU |
| Asparagine | Asn | N | AAC; AAU |
| Aspartic; Acid | Asp | D | GAC; GAU |
| Cysteine | Cys | C | UGC; UGU |
| Glutamic; acid | Glu | E | GAA; GAG |
| Glutamine | Gln | Q | CAA; CAG |
| Glycine | Gly | G | GGA; GGC; GGG; GGU |
| Histidine | His | H | CAC; CAU |
| Isoleucine | Ile | I | AUA; AUC; AUU |
| Leucine | Leu | L | UUA; UUG; CUA; CUC; CUG; CUU |
| Lysine | Lys | K | AAA; AAG |
| Methionine; | Met | M | AUG |
| Phenylalanine | Phe | F | UUC; UUU |

-continued

| Amino Acid | 3-Letter | 1-Letter | Codons |
|---|---|---|---|
| Proline | Pro | P | CCA; CCC; CCG; CCU |
| Serine | Ser | S | ACG; AGU; UCA; UCC; UCG; UCU |
| Threonine | Thr | T | ACA; ACC; ACG; ACU |
| Tryptophan | Trp | W | UGG |
| Tyrosine | Tyr | Y | UAC; UAU |
| Valine | Val | V | GUA; GUC; GUG; GUU |

BACKGROUND

Improvement of the agronomic characteristics of crop plants has been ongoing since the beginning of agriculture. Most of the land suitable for crop production is currently being used. As human populations continue to increase, improved crop varieties will be required to adequately provide food and feed (Trewavas, 2001). To avoid catastrophic famines and malnutrition, future crop cultivars will need to have improved yields with equivalent farm inputs. These cultivars will need to more effectively withstand adverse conditions such as drought, soil salinity, and disease, which will be especially important as marginal lands are brought into cultivation. Finally, cultivars are needed with altered nutrient composition to enhance human and animal nutrition. To allow for more efficient food and feed processing, cultivars can be designed for specific end-uses. For all these uses, identification of the genes controlling phenotypic expression of traits of interest will play a role in accelerating development of superior crop germplasm by conventional or transgenic approaches.

A number of highly efficient approaches are available to assist identification of genes playing key roles in expression of agronomically important traits, including genetics, genomics, bioinformatics, and functional genomics. Genetics is the scientific study of the mechanisms of inheritance. By identifying mutations that alter a pathway or response of interest, classical (or forward) genetics can help identify genes involved in these pathways or responses. Genetics is also the central component in improvement of germplasm by breeding. Through molecular and phenotypic analysis of genetic crosses, loci controlling traits of interest can be mapped and followed in subsequent generations. Knowledge of the genes underlying phenotypic variation between crop accessions can facilitate the development of markers that greatly increase the efficiency of the germplasm improvement process as well as open avenues for discovery of additional superior alleles.

Genomics is the system-level study of an organism's genome, including genes and the corresponding gene products: RNA and polypeptides. At a first level, genomic approaches have provided large datasets of sequence information from diverse plant species, including full-length and partial cDNA sequences and the complete genomic sequence of a model plant species, *Arabidopsis thaliana*. Recently, the first draft sequence of a crop plant's genome, that of rice (*Oryza sativa*), has also become available (see Goff et al., 2002). The availability of a whole genome sequence makes possible the development of tools for system-level study of other molecular complements, such as by using arrays and chips to determine the complement of expressed genes in an organism under specific conditions. Such data can be used as a first indication of the potential for certain genes to play key roles in expression of different plant phenotypes. Bioinformatics approaches interface directly with first-level genomic datasets in allowing for the identification of sequences of interest by annotative or other means. Using, for example, similarity searches, alignments, and phylogenetic analyses, bioinformatics can often identify homologs of a gene product of interest. Very similar homologs (for example, greater than about 90% amino acid identity over the entire length of a polypeptide) are likely to be orthologs; that is, they are likely to share the same function in different organisms.

Functional genomics can be defined as the assignment of functions to genes and gene products. Functional genomics draws from genetics, genomics, and bioinformatics to derive a path toward identifying genes involved in a particular pathway or response of interest. Expression analysis, for example, uses high density DNA microarrays (often derived from genome-scale organismal sequencing) to monitor the mRNA expression of thousands of genes in a single experiment. Experimental treatments can include those eliciting a response of interest, such as the drought resistance response in plants subjected to low water conditions. To give additional examples of the use of microarrays, mRNA expression levels can be monitored in distinct tissues over a developmental time course, or in mutants affected in a response of interest.

Proteomics can also help to assign function by assaying the expression and post-translational modifications of hundreds of polypeptides in a single experiment. Proteomics approaches are in many cases analogous to the approaches taken for monitoring mRNA expression in microarray experiments. Polypeptide-polypeptide interactions can also help to assign polypeptides to a given pathway or response by identifying polypeptides which interact with known components of the pathway or response. For functional genomics, polypeptide-polypeptide interactions are often studied using large-scale yeast two-hybrid assays. Another approach to assigning gene function is to express the corresponding polypeptide in a heterologous host, for example the bacterium *Escherichia coli*, followed by purification and enzymatic assays of the purified polypeptide.

Ultimately, demonstration of the ability of a gene-of-interest to control a given trait is derived from experimental testing in a plant species of interest. The generation and analysis of plants that are transgenic for a gene of interest can be used for plant functional genomics, with several advantages. The gene can alternatively be either overexpressed (via transgenesis) or underexpressed ("knocked out"), thereby increasing the chances of observing a phenotype linking the gene to a pathway or response of interest.

Two aspects of transgenic functional genomics help lend a high level of confidence to functional assignments derived from this approach. First, phenotypic observations are carried out in the context of the living plant. Second, the range of phenotypes observed can be checked and correlated with the observed expression levels of the introduced transgene. Transgenic functional genomics is especially valuable in improved cultivar development. Only genes that function in a pathway or response of interest and that in addition are able to confer a desired trait-based phenotype are promoted as candidate genes for crop improvement efforts. In some cases, transgenic lines developed for functional genomics studies can be directly utilized in the initial stages of product development.

Another approach towards plant functional genomics involves first identifying plant lines with mutations in specific genes of interest, followed by phenotypic evaluation of the consequences of such gene knockouts on the trait under study. Such an approach reveals genes essential for the expression of specific traits.

Genes identified through functional genomics can be directly employed in efforts towards germplasm improvement by transgenic approaches as disclosed above, or used to develop markers for identification and tracking of alleles-of-interest in mapping and breeding populations. Knowledge of such genes can also enable the construction by any of a number of molecular methods of superior alleles that are non-existent in nature.

Therefore, the identification of genes that can be used for crop and germplasm improvement is needed. This and other needs in the art are addressed by the present disclosure.

SUMMARY

This Summary lists several embodiments of the presently disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this Summary or not. To avoid excessive repetition, this Summary does not list or suggest all possible combinations of such features.

The presently disclosed subject matter provides nucleic acids and polypeptides from *Oryza sativa*. In some embodiments, the presently disclosed subject matter provides a polypeptide selected from the group consisting of (a) a polypeptide having an amino acid sequence of one of even numbered SEQ ID NOs: 2-196; (b) a polypeptide having an amino acid sequence that is at least 60% identical to and having a same function as a polypeptide having an amino acid sequence of one of even numbered SEQ ID NOs: 2-196; (c) a polypeptide having an amino acid sequence encoded by a nucleotide sequence substantially identical to a nucleotide sequence of one of odd numbered SEQ ID NOs: 1-195; (d) a polypeptide having an amino acid sequence encoded by a nucleic acid molecule capable of hybridizing under highly stringent conditions to a nucleic acid molecule of one of odd numbered SEQ ID NOs: 1-195 or to a sequence fully complementary thereto; and (e) a functional fragment of the polypeptide encoded by the amino acid sequence of (a), (b), (c) or (d). In some embodiments, the polypeptide functions in abiotic stress tolerance. In some embodiments, the abiotic stress tolerance is drought resistance.

The presently disclosed subject matter also provides an isolated nucleic acid molecule comprising a nucleotide sequence, its full complement, or its full reverse complement, the nucleotide sequence encoding a polypeptide selected from the group consisting of: (a) a polypeptide having an amino acid sequence listed in even numbered sequences of SEQ ID NOs: 2-196, or a functional fragment, domain, repeat, or feature thereof; (b) a polypeptide having an amino acid sequence that is at least 60% identical to and having a same function as a polypeptide having an amino acid sequence of one of even numbered SEQ ID NOs: 2-196; (c) a polypeptide having an amino acid sequence encoded by a nucleotide sequence having substantial identity to a nucleotide sequence listed in odd numbered sequences of SEQ ID NOs: 1-195, or a functional fragment, domain, or feature thereof, or a sequence fully complementary thereto; and (d) a polypeptide sequence encoded by a nucleotide sequence capable of hybridizing under medium stringency conditions to a nucleotide sequence listed in odd numbered sequences of SEQ ID NOs: 1-195, or to a sequence fully complementary thereto;

The presently disclosed subject matter also provides an isolated nucleic acid molecule comprising a nucleotide sequence, wherein the nucleotide sequence is selected from the group consisting of: (a) a nucleotide sequence listed in odd numbered sequences of SEQ ID NOs: 1-195, or a functional fragment, domain, or feature thereof; (b) a nucleotide sequence that is at least 60% identical to (a); (c) a nucleotide sequence capable of hybridizing to (a) under medium stringency conditions; (d) a nucleotide sequence complementary to (a), (b) or (c); and (e) a nucleotide sequence which is the reverse complement of (a), (b) or (c).

The presently disclosed subject matter also provides an expression cassette comprising a promoter operatively linked to one or more of the disclosed nucleic acid molecules. In some embodiments, the presently disclosed subject matter provides a recombinant vector comprising the disclosed expression cassette. In some embodiments, the presently disclosed subject matter also provides a cell comprising an expression cassette.

In some embodiments, the presently disclosed subject matter provides a transgenic plant comprising the disclosed expression cassette. In some embodiments, the expression cassette is expressed in a tissue selected from the group consisting of the epidermis, root, vascular tissue, meristem, cambium, cortex, pith, leaf, flower, and combinations thereof.

In some embodiments, the transgenic plant is a monocot. In some embodiments, the monocot is selected from the group consisting of rice, maize, wheat, barley, oats, rye, millet, sorghum, trticale, *secale*, einkorn, spelt, emmer, teff, milo, flax, gramma grass, *Tripsacum*, and teosinte. In some embodiments, the transgenic plant is selected from the group consisting of rice, wheat, barley, rye, corn, potato, canola, soybean, sunflower, carrot, sweet potato, sugarbeet, bean, pea, chicory, lettuce, cabbage, cauliflower, broccoli, turnip, radish, spinach, asparagus, onion, garlic, eggplant, pepper, celery, squash, pumpkin, cucumber, apple, pear, quince, melon, plum, cherry, peach, nectarine, apricot, strawberry, grape, raspberry, blackberry, pineapple, avocado, papaya, mango, banana, soybean, tobacco, tomato, sorghum and sugarcane. In some embodiments, the transgenic plant is rice.

In some embodiments of the disclosed transgenic plant, the plant has altered abiotic stress tolerance. In some embodiments, the altered abiotic stress tolerance is enhanced drought resistance.

The presently disclosed subject matter also provides a transgenic plant comprising a disclosed nucleic acid molecule.

Additionally, the presently disclosed subject matter provides progeny and seed from the disclosed transgenic plants.

The presently disclosed subject matter also provides a method for altering an abiotic stress tolerance of a plant, the method comprising expressing in the plant an expression cassette comprising a nucleic acid molecule encoding a disclosed polypeptide.

The presently disclosed subject matter also provides a shuffled nucleic acid. In some embodiments, the shuffled nucleic acid molecule comprises a plurality of nucleotide sequence fragments, wherein at least one of the fragments corresponds to a region of a nucleotide sequence listed in odd numbered sequences of SEQ ID NOs: 1-195, and wherein at least two of the plurality of sequence fragments are in an order, from 5' to 3', which is not an order in which the plurality of fragments naturally occur in a nucleic acid.

The presently disclosed subject matter also provides a method for producing a polypeptide encoded by a disclosed nucleic acid molecule. In some embodiments, the method comprises: (a) growing cells comprising an expression cassette under suitable growth conditions, the expression cassette comprising a nucleic acid molecule encoding a disclosed polypeptide; and (b) isolating the polypeptide from the cells.

The presently disclosed subject matter also provides a method for decreasing the expression of a disclosed nucleic acid molecule in a plant. In some embodiments, the method is selected from the group consisting of: (a) expressing in said plant a nucleic acid molecule encoding a disclosed polypeptide or a portion thereof in "sense" orientation; (b) expressing in said plant a nucleic acid encoding a disclosed polypeptide molecule or a portion thereof in "antisense" orientation; (c) expressing in said plant a ribozyme capable of specifically cleaving a messenger RNA transcript encoded by an endogenous gene corresponding to a disclosed nucleic acid molecule; (d) expressing in a plant an aptamer specifically directed to a polypeptide encoded by a disclosed isolated nucleic acid molecule; (e) expressing in a plant a mutated or a truncated form of a disclosed isolated nucleic acid molecule; (f) modifying by homologous recombination in a plant at least one chromosomal copy of the gene corresponding to a disclosed isolated nucleic acid molecule; (g) modifying by homologous recombination in a plant at least one chromosomal copy of the regulatory elements of a gene corresponding to a disclosed isolated nucleic acid molecule; and (h) expressing in said plant a disclosed isolated nucleic acid molecule or a portion thereof in the "sense" and "antisense" orientation.

The presently disclosed subject matter also provides a method for increasing the expression of a disclosed isolated nucleic acid molecule in a plant. In some embodiments, the method comprises: (a) inserting into the plant an expression cassette comprising a disclosed isolated nucleic acid molecule; and (b) growing the plant comprising the expression cassette under suitable growth conditions, wherein the expression of the disclosed isolated nucleic acid molecule is increased.

The presently disclosed subject matter also provides a method for enhancing the drought resistance of a plant. In some embodiments, the method comprises: (a) inserting into the plant an expression cassette comprising at least one disclosed isolated nucleic acid molecule; and (b) growing the plant comprising the expression cassette under suitable growth conditions, wherein the drought resistance of the plant is enhanced.

The presently disclosed subject matter also provides an antibody that specifically binds to a disclosed polypeptide.

The presently disclosed subject matter also provides a method for altering the expression of a disclosed polypeptide in a plant. In some embodiments, the method comprises expressing an expression cassette encoding a disclosed polypeptide in the plant. In some embodiments, the polypeptide is expressed in a predetermined location or tissue of a plant. In some embodiments, the location or tissue is selected from the group consisting of epidermis, root, vascular tissue, meristem, cambium, cortex, pith, leaf, flower, seed, and combinations thereof.

The presently disclosed subject matter also provides an isolated product from a plant comprising an expression cassette comprising a promoter sequence operatively linked to a nucleic acid, the nucleic acid comprising a nucleotide sequence selected from the group consisting of: (a) a nucleotide sequence listed in odd numbered sequences of SEQ ID NOs: 1-195, or a functional fragment, domain, or feature thereof; (b) a nucleotide sequence encoding a polypeptide listed in even numbered sequences of SEQ ID NOs: 2-196; (c) a nucleotide sequence that is at least 60% identical to (a) or (b); (d) a nucleotide sequence capable of hybridizing to (a) or (b) under medium stringency conditions; (e) a nucleotide sequence fully complementary to (a), (b), (c) or (d); and (f) a nucleotide sequence that is the full reverse complement of (a), (b), (c) or (d).

The presently disclosed subject matter also provides a method for producing a recombinant polypeptide. In some embodiments, the method comprises: (a) growing recombinant cells comprising a nucleic acid construct under suitable growth conditions, the construct comprising an expression vector and a nucleic acid comprising a nucleic acid selected from the group consisting of: (i) a nucleic acid encoding a polypeptide as listed in even numbered nucleotide sequences of SEQ ID NOs: 2-196; (ii) a nucleic acid sequence listed in odd numbered nucleotide sequences of SEQ ID NOs: 1-195; and (iii) a subsequence of (i) or (ii); and (b) isolating from the recombinant cells the recombinant polypeptide expressed therein. In some embodiments, the expression vector comprises one or more elements selected from the group consisting of a promoter-enhancer sequence, a selection marker sequence, an origin of replication, an epitope tag-encoding sequence, an affinity purification tag-encoding sequence, a polyamino acid binding substance, and chitin-binding domain, and combinations thereof.

BRIEF DESCRIPTION OF THE SEQUENCE LISTING

Odd numbered SEQ ID NOs: 1-195 are nucleotide sequences isolated from Oryza sativa that are more fully disclosed in Tables 4 and 6 below.

Even numbered SEQ ID NOs: 2-196 are polypeptide sequences encoded by the immediately preceding nucleotide sequence. For example, SEQ ID NO: 2 is the polypeptide encoded by the nucleotide sequence of SEQ ID NO: 1, SEQ ID NO: 4 is the polypeptide encoded by the nucleotide sequence of SEQ ID NO: 3, etc.

SEQ ID NO: 197 is the amino acid sequence of the V5 epitope from paramyxovirus.

SEQ ID NO: 198 is the amino acid sequence of an epitope tag.

DETAILED DESCRIPTION

The presently disclosed subject matter will be now be described more fully hereinafter with reference to the accompanying Examples, in which representative embodiments of the presently disclosed subject matter are shown. The presently disclosed subject matter can, however, be embodied in different forms and should not be construed as limited to the embodiments set forth herein. Rather, these embodiments are provided so that this disclosure will be thorough and complete, and will fully convey the scope of the presently disclosed subject matter to those skilled in the art.

All publications, patent applications, patents, and other references mentioned herein are incorporated by reference in their entireties.

I. GENERAL CONSIDERATIONS

A goal of functional genomics is to identify genes controlling expression of organismal phenotypes, and functional genomics employs a variety of methodologies including, but not limited to, bioinformatics, gene expression studies, gene and gene product interactions, genetics, biochemistry, and molecular genetics. For example, bioinformatics can assign function to a given gene by identifying genes in heterologous organisms with a high degree of similarity (homology) at the amino acid or nucleotide level. Studies of the expression of a gene at the mRNA or polypeptide levels can assign function by linking expression of the gene to an environmental response, a developmental process, or a genetic (mutational) or molecular genetic (gene overexpression or underexpression) perturbation. Expression of a gene at the mRNA level can be ascertained either alone (for example, by Northern analysis) or in concert with other genes (for example, by microarray analysis), whereas expression of a gene at the polypeptide level can be ascertained either alone (for example, by native or denatured polypeptide gel or immunoblot analysis) or in concert with other genes (for example, by proteomic analysis). Knowledge of polypeptide/polypeptide and polypeptide/DNA interactions can assign function by identifying polypeptides and nucleic acid sequences acting together in the same biological process. Genetics can assign function to a gene by demonstrating that DNA lesions (mutations) in the gene have a quantifiable effect on the organism, including, but not limited to, its development; hormone biosynthesis and response; growth and growth habit (plant architecture); mRNA expression profiles; polypeptide expression profiles; ability to resist diseases; tolerance of abiotic stresses (for example, drought conditions); ability to acquire nutrients; photosynthetic efficiency; altered primary and secondary metabolism; and the composition of various plant organs. Biochemistry can assign function by demonstrating that the polypeptide(s) encoded by the gene, typically when expressed in a heterologous organism, possesses a certain functional activity, either alone or in combination with other polypeptides. Molecular genetics can assign function by studying the overexpression or underexpression of a gene in the native plant or in heterologous organisms, and observing quantifiable effects as disclosed in functional assignment by genetics above. In functional genomics, any or all of these approaches are utilized, often in concert, to assign functions to genes across any of a number of organismal phenotypes.

It is recognized by those skilled in the art that these different methodologies can each produce evidence for the function of a particular gene, and that such evidence is stronger as increasing amounts of data are used for functional assignment: in some embodiments from a single methodology, in some embodiments from two methodologies, and in some embodiments from more than two methodologies. In addition, those skilled in the art are aware that different methodologies can differ in the strength of the evidence provided for the assignment of gene function. Typically, but not always, a datum of biochemical, genetic, or molecular genetic evidence is considered stronger than a datum of bioinformatic or gene expression evidence. Finally, those skilled in the art recognize that for different genes, a single datum from a single methodology can differ in terms of the strength of the evidence provided by each distinct datum for the assignment of the function of these different genes.

The objective of crop trait functional genomics is to identify crop trait genes of interest, for example, genes capable of conferring useful agronomic traits in crop plants. Such agronomic traits include, but are not limited to, enhanced yield, whether in quantity or quality; enhanced nutrient acquisition and metabolic efficiency; enhanced or altered nutrient composition of plant tissues used for food, feed, fiber, or processing; enhanced utility for agricultural or industrial processing; enhanced resistance to plant diseases; enhanced tolerance of adverse environmental conditions (abiotic stresses) including, but not limited to, drought, excessive cold, excessive heat, or excessive soil salinity or extreme acidity or alkalinity; and alterations in plant architecture or development, including changes in developmental timing. The deployment of such identified trait genes by either transgenic or non-transgenic means can materially improve crop plants for the benefit of agriculture.

Cereals are the most important crop plants on the planet in terms of both human and animal consumption. Genomic synteny (conservation of gene order within large chromosomal segments) is observed in rice, maize, wheat, barley, rye, oats, and other agriculturally important monocots, which facilitates the mapping and isolation of orthologous genes from diverse cereal species based on the sequence of a single cereal gene. Rice has the smallest (about 420 Mb) genome among the cereal grains, and has recently been a major focus of public and private genomic and EST sequencing efforts. See Goff et al., 2002.

In one aspect of the presently disclosed subject matter and to identify crop trait genes in the rice genome controlling responses to abiotic stress, genes from the rice draft genome sequence were prioritized based on one or more functional genomic methodologies. For example, genome-wide expression studies of rice plants grown under different conditions of water availability were used to prioritize candidate genes controlling drought resistance. Full-length and partial cDNAs of rice trait gene candidates were then analyzed based on analysis of the rice whole-genome sequence and isolated by designing and using primers for PCR amplification using a commercially available PCR primer-picking program. Primers were used for PCR amplification of full-length or partial cDNAs from rice cDNA libraries or first-strand cDNA. cDNA clones resulting from either approach were used for the construction of vectors designed for altering expression of these genes in transgenic plants using plant molecular genetic methodologies, which are disclosed in detail below. Alteration of plant phenotype through overexpression or underexpression of key trait genes in transgenic plants is a robust and established method for assigning functions to plant genes. Assays to identify transgenic plants with alterations in traits of interest can be used to unambiguously assign the usefulness of these genes for the improvement of rice, and by extension, other cereals, either by transgenic or classical breeding methods.

II. DEFINITIONS

Unless otherwise defined, all technical and scientific terms used herein have the same meaning as commonly understood by one of ordinary skill in the art to which the presently disclosed subject matter pertains. For clarity of the present specification, certain definitions are presented hereinbelow.

Following long-standing patent law convention, the terms "a" and "an" mean "one or more" when used in this application, including in the claims.

As used herein, the phrase "altered abiotic stress tolerance" refers to a state wherein a plant exhibits a different response to abiotic stress (for example, low water conditions) than does another plant of the same species as a result of a manipulation of the plant's genome. In some embodiments, altered abiotic stress tolerance comprises enhanced drought resistance, wherein "enhanced drought resistance" is defined as an increased ability of a plant (for example, a recombinant or transgenic plant) to withstand periods of low water abundance as compared to a native plant of the same species. As used herein, the phrase "altering an abiotic stress tolerance" refers in some embodiments to a manipulation of a plant's genome to produce a recombinant or transgenic plant in which the manipulation results in a change in the plant's abiotic stress tolerance. In some embodiments, altering an abiotic stress tolerance comprises enhancing a plant's resistance to drought.

As used herein, the terms "associated with" and "operatively linked" refer to two nucleic acid sequences that are related physically or functionally. For example, a promoter or regulatory DNA sequence is said to be "associated with" a DNA sequence that encodes an RNA or a polypeptide if the two sequences are operatively linked or situated such that the regulator DNA sequence will affect the expression level of the coding or structural DNA sequence.

As used herein, the term "chimera" refers to a nucleic acid or polypeptide that encodes or comprises domains or other features that are derived from different nucleic acids or polypeptides or are in a position relative to each other that is not naturally occurring.

As used herein, the term "chimeric construct" refers to a recombinant nucleic acid molecule in which a promoter or regulatory nucleic acid sequence is operatively linked to, or associated with, a nucleic acid sequence that codes for an mRNA or which is expressed as a polypeptide, such that the regulatory nucleic acid sequence is able to regulate transcription or expression of the associated nucleic acid sequence. The regulatory nucleic acid sequence of the chimeric construct is not normally operatively linked to the associated nucleic acid sequence as found in nature.

As used herein, the term "co-factor" refers to a natural reactant, such as an organic molecule or a metal ion, required in an enzyme-catalyzed reaction. A co-factor can be, for example, NAD(P), riboflavin (including FAD and FMN), folate, molybdopterin, thiamin, biotin, lipoic acid, pantothenic acid and coenzyme A, S-adenosylmethionine, pyridoxal phosphate, ubiquinone, and menaquinone. In some embodiments, a co-factor can be regenerated and reused.

As used herein, the terms "coding sequence" and "open reading frame" (ORF) are used interchangeably and refer to a nucleic acid sequence that is transcribed into RNA such as mRNA, rRNA, tRNA, snRNA, sense RNA, or antisense RNA. In some embodiments, the RNA is then translated in vivo or in vitro to produce a polypeptide.

As used herein, the term "complementary" refers to two nucleotide sequences that comprise antiparallel nucleotide sequences capable of pairing with one another upon formation of hydrogen bonds between the complementary base residues in the antiparallel nucleotide sequences. As is known in the art, the nucleic acid sequences of two complementary strands are the reverse complement of each other when each is viewed in the 5' to 3' direction. Unless specifically indicated to the contrary, the term "complementary" as used herein refers to 100% complementarity throughout the length of at least one of the two antiparallel nucleotide sequences.

As used herein, the terms "domain" and "feature", when used in reference to a polypeptide or amino acid sequence, refers to a subsequence of an amino acid sequence that has a particular biological function. Domains and features that have a particular biological function include, but are not limited to, ligand binding, nucleic acid binding, catalytic activity, substrate binding, and polypeptide-polypeptide interacting domains. Similarly, when used herein in reference to a nucleic acid sequence, a "domain" or "feature" is that subsequence of the nucleic acid sequence that encodes a domain or feature of a polypeptide. Particularly with reference to a nucleic acid molecule, a "domain" or "feature" is also intended to encompass nucleotide sequences that have a function apart from encoding a domain or feature of a polypeptide. For example, a nucleotide sequence that binds a polypeptide can also be a "domain" (in this case, a protein binding domain).

As used herein, the term "enzyme activity" refers to the ability of an enzyme to catalyze the conversion of a substrate into a product. A substrate for the enzyme can comprise the natural substrate of the enzyme but also can comprise analogues of the natural substrate, which can also be converted by the enzyme into a product or into an analogue of a product. The activity of the enzyme is measured for example by determining the amount of product in the reaction after a certain period of time, or by determining the amount of substrate remaining in the reaction mixture after a certain period of time. The activity of the enzyme can also be measured by determining the amount of an unused co-factor of the reaction remaining in the reaction mixture after a certain period of time or by determining the amount of used co-factor in the reaction mixture after a certain period of time. The activity of the enzyme can also be measured by determining the amount of a donor of free energy or energy-rich molecule (e.g. ATP, phosphoenolpyruvate, acetyl phosphate, or phosphocreatine) remaining in the reaction mixture after a certain period of time or by determining the amount of a used donor of free energy or energy-rich molecule (e.g. ADP, pyruvate, acetate, or creatine) in the reaction mixture after a certain period of time.

As used herein, the term "expression cassette" refers to a nucleic acid molecule capable of directing expression of a particular nucleotide sequence in an appropriate host cell, comprising a promoter operatively linked to the nucleotide sequence of interest which is operatively linked to termination signals. It also typically comprises sequences required for proper translation of the nucleotide sequence. The coding region usually encodes a polypeptide of interest but can also encode a functional RNA of interest, for example antisense RNA or a non-translated RNA in the sense or antisense direction.

The expression cassette comprising the nucleotide sequence of interest can be chimeric, meaning that at least one of its components is heterologous with respect to at least one of its other components. The expression cassette can also be one that is naturally occurring but has been obtained in a recombinant form useful for heterologous expression. Typically, however, the expression cassette is heterologous with respect to the host; i.e., the particular DNA sequence of the expression cassette does not occur naturally in the host cell and was introduced into the host cell or an ancestor of the host cell by a transformation event. The expression of the nucleotide sequence in the expression cassette can be under the control of a constitutive promoter or of an inducible promoter that initiates transcription only when the host cell is exposed to some particular external stimulus. In the case of a multicellular organism such as a plant, the promoter can also be specific to a particular cell type, tissue, organ, or stage of development.

As used herein, the term "fragment" refers to a sequence that comprises a subset of another sequence. When used in the context of a nucleic acid or amino acid sequence, the terms "fragment" and "subsequence" are used interchangeably. A fragment of a nucleic acid sequence can be any number of nucleotides that is less than that found in another nucleic acid sequence, and thus includes, but is not limited to, the sequences of an exon or intron, a promoter, an enhancer, an origin of replication, a 5' or 3' untranslated region, a coding region, and/or a polypeptide binding domain. It is understood that a fragment or subsequence can also comprise less than the entirety of a nucleic acid sequence, for example, a portion of an exon or intron, promoter, enhancer, etc. Similarly, a fragment or subsequence of an amino acid sequence can be any number of residues that is less than that found in a naturally occurring polypeptide, and thus includes, but is not limited to, domains, features, repeats, etc. Also similarly, it is understood that a fragment or subsequence of an amino acid sequence need not comprise the entirety of the amino acid sequence of the domain, feature, repeat, etc. A fragment can also be a "functional fragment", in which the fragment retains a specific biological function of the nucleic acid sequence or amino acid sequence of interest. For example, a functional fragment of a transcription factor can include, but is not limited to, a DNA binding domain, a transactivating domain, or both. Similarly, a functional fragment of a receptor tyrosine kinase includes, but is not limited to a ligand binding domain, a kinase domain, an ATP binding domain, and combinations thereof.

As used herein, the term "gene" is used broadly to refer to any segment of DNA associated with a biological function. Thus, genes include, but are not limited to, coding sequences and/or the regulatory sequences required for their expression. Genes can also include non-expressed DNA segments that, for example, form recognition sequences for a polypeptide. Genes can be obtained from a variety of sources, including cloning from a source of interest or synthesizing from known or predicted sequence information, and can include sequences designed to have desired parameters.

The terms "heterologous", "recombinant", and "exogenous", when used herein to refer to a nucleic acid sequence (e.g. a DNA sequence) or a gene, refer to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling or other recombinant techniques. The terms also include non-naturally occurring multiple copies of a naturally occurring DNA sequence. Thus, the terms refer to a DNA segment that is foreign to the cell, or homologous to the cell but in a position or form within the host cell in which the element is not ordinarily found. Similarly, when used in the context of a polypeptide or amino acid sequence, an exogenous polypeptide or amino acid sequence is a polypeptide or amino acid sequence that originates from a source foreign to the particular host cell or, if from the same source, is modified from its original form. Thus, exogenous DNA segments can be expressed to yield exogenous polypeptides.

An "endogenous" or "native" nucleic acid (or amino acid) sequence is a nucleic acid (or amino acid) sequence naturally associated with a host cell into which it is introduced. In this context, the terms "heterologous" and "endogenous" are antonymous.

The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. The phrase "bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

As used herein, the term "inhibitor" refers to a chemical substance that inactivates or decreases the biological activity of a polypeptide such as a biosynthetic and catalytic activity, receptor, signal transduction polypeptide, structural gene product, or transport polypeptide. The term "herbicide" (or "herbicidal compound") is used herein to define an inhibitor applied to a plant at any stage of development, whereby the herbicide inhibits the growth of the plant or kills the plant.

As used herein, the term "isolated", when used in the context of an isolated nucleic acid or an isolated polypeptide, is a nucleic acid or polypeptide that, by the hand of man, exists apart from its native environment and is therefore not a product of nature. An nucleic acid molecule or polypeptide can exist in a purified form or can exist in a non-native environment such as, for example, in a transgenic host cell.

As used herein, the term "mature polypeptide" refers to a polypeptide from which the transit peptide, signal peptide, and/or propeptide portions have been removed.

As used herein, the term "minimal promoter" refers to the smallest piece of a promoter, such as a TATA element, that can support any transcription. A minimal promoter typically has greatly reduced promoter activity in the absence of upstream or downstream activation. In the presence of a suitable transcription factor, a minimal promoter can function to permit transcription.

As used herein, the term "modified enzyme activity" refers to enzyme activity that is different from that which naturally occurs in a plant (i.e. enzyme activity that occurs naturally in the absence of direct or indirect manipulation of such activity by man). In some embodiments, a modified enzyme activity is displayed by a non-naturally occurring enzyme that is tolerant to inhibitors that inhibit the cognate naturally occurring enzyme activity.

As used herein, the term "native" refers to a gene that is naturally present in the genome of an untransformed plant cell. Similarly, when used in the context of a polypeptide, a "native polypeptide" is a polypeptide that is encoded by a native gene of an untransformed plant cell's genome. Thus, the terms "native" and "endogenous" are synonymous.

As used herein, the term "naturally occurring" refers to an object that is found in nature as distinct from being artificially produced or manipulated by man. For example, a polypeptide or nucleotide sequence that is present in an organism (including a virus) in its natural state, which has not been intentionally modified or isolated by man in the laboratory, is naturally occurring. As such, a polypeptide or nucleotide sequence is considered "non-naturally occurring" if it is encoded by or present within a recombinant molecule, even if the amino acid or nucleic acid sequence is identical to an amino acid or nucleic acid sequence found in nature.

As used herein, the term "nucleic acid" refers to deoxyribonucleotides or ribonucleotides and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g. degenerate codon substitutions) and complementary sequences and as well as the sequence explicitly indicated. Specifically, degenerate codon substitutions can be achieved by generating sequences in which the third position of one or more selected (or all) codons is substituted with mixed-base and/or deoxyinosine residues (Batzer et al., 1991; Ohtsuka et al., 1985; Rossolini et al., 1994). The terms "nucleic acid" or "nucleic acid sequence" can also be used interchangeably with gene, cDNA, and mRNA encoded by a gene.

As used herein, the phrase "percent identical"," in the context of two nucleic acid or polypeptide sequences, refers to two or more sequences or subsequences that have in some embodiments 60%, in some embodiments 70%, in some embodiments 80%, in some embodiments 90%, in some embodiments 95%, and in some embodiments at least 99% nucleotide or amino acid residue identity, respectively, when compared and aligned for maximum correspondence, as measured using one of the following sequence comparison algorithms or by visual inspection. The percent identity exists in some embodiments over a region of the sequences that is at least about 50 residues in length, in some embodiments over a region of at least about 100 residues, and in some embodiments, the percent identity exists over at least about 150 residues. In some embodiments, the percent identity exists over the entire length of the sequences.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, for example, by the local homology algorithm disclosed in Smith & Waterman, 1981, by the homology alignment algorithm disclosed in Needleman & Wunsch, 1970, by the search for similarity method disclosed in Pearson & Lipman, 1988, by computerized implementations of these algorithms (GAP, BESTFIT, FASTA, and TFASTA in the GCG® WISCONSIN PACKAGE®, available from Accelrys, Inc., San Diego, Calif., United States of America), or by visual inspection. See generally, Altschul et al., 1990; Ausubel et al., 2002 and Ausubel et al., 2003.

One example of an algorithm that is suitable for determining percent sequence identity and sequence similarity is the BLAST algorithm, which is described in Altschul et al., 1990. Software for performing BLAST analysis is publicly available through the website of the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. See generally, Altschul et al., 1990. These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix. See Henikoff & Henikoff, 1992.

In addition to calculating percent sequence identity, the BLAST algorithm also performs a statistical analysis of the similarity between two sequences (see e.g., Karlin & Altschul, 1993). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is in some embodiments less than about 0.1, in some embodiments less than about 0.01, and in some embodiments less than about 0.001.

As used herein, the term "shuffled nucleic acid" refers to a recombinant nucleic acid molecule in which the nucleotide sequence comprises a plurality of nucleotide sequence fragments, wherein at least one of the fragments corresponds to a region of a nucleotide sequence listed in odd numbered sequences of SEQ ID NOs: 1-195, and wherein at least two of the plurality of sequence fragments are in an order, from 5' to 3', which is not an order in which the plurality of fragments naturally occur in a nucleic acid.

The term "substantially identical", in the context of two nucleotide or amino acid sequences, refers to two or more sequences or subsequences that have in some embodiments at least about 60% nucleotide or amino acid identity, in some embodiments at least about 65% nucleotide or amino acid identity, in some embodiments at least about 70% nucleotide or amino acid identity, in some embodiments at least about 75% nucleotide or amino acid identity, in some embodiments at least about 80% nucleotide or amino acid identity, in some embodiments at least about 85% nucleotide or amino acid identity, in some embodiments at least about 90% nucleotide or amino acid identity, in some embodiments at least about 91% nucleotide or amino acid identity, in some embodiments at least about 92% nucleotide or amino acid identity, in some embodiments at least about 93% nucleotide or amino acid identity, in some embodiments at least about 94% nucleotide or amino acid identity, in some embodiments at least about 95% nucleotide or amino acid identity, in some embodiments at least about 96% nucleotide or amino acid identity, in some embodiments at least about 97% nucleotide or amino acid identity, in some embodiments at least about 98% nucleotide or amino acid identity, in some embodiments at least about 99% nucleotide or amino acid identity, and in some embodiments at least about 100% nucleotide or amino acid identity, when compared and aligned for maximum correspondence, as measured using one of the above-referenced sequence comparison algorithms or by visual inspection. In one example, the substantial identity exists in nucleotide or amino acid sequences of at least 50 residues, in another example in nucleotide or amino acid sequence of at least about 100 residues, in another example in nucleotide or amino acid sequences of at least about 150 residues, and in yet another example in nucleotide or amino acid sequences comprising complete coding sequences or complete amino acid sequences.

In some embodiments, two nucleic acid or amino acid sequences that are substantially identical also have the same function. In these embodiments, the phrase "the same function" applies to two or more nucleic acid molecules or polypeptides that perform the same biochemical role in either different cells types in the same plant, similar cell types in the same plant, similar cell types in different plants, or even different cell types in different plants. Exemplary functions include, but are not limited to kinase activity, phosphatase activity, nucleic acid binding activity, heat shock activity, and any other enzymatic activity. Two nucleic acids or polypeptides are also deemed to have "the same function" if they participate in the same step of a biochemical pathway, bind to the same, or similar substrates, or produce the same or similar products as a result of their biochemical activities. Exemplary non-limited pathways in which the nucleic acids and polypeptides of the presently disclosed subject matter can function include carbon metabolism, photosynthesis, signal transduction, cell growth, reproduction, disease processes, gene regulation, abiotic stress tolerance, and disease resistance.

In one aspect, polymorphic sequences can be substantially identical sequences. The term "polymorphic" refers to the two or more genetically determined alternative sequences or alleles in a population. An allelic difference can be as small as one base pair. Nonetheless, one of ordinary skill in the art would recognize that the polymorphic sequences correspond to the same gene.

Another indication that two nucleotide sequences are substantially identical is that the two molecules specifically or substantially hybridize to each other under conditions of medium or high stringency. In the context of nucleic acid hybridization, two nucleic acid sequences being compared can be designated a "probe sequence" and a "target sequence". A "probe sequence" is a reference nucleic acid molecule, and a "target sequence" is a test nucleic acid molecule, often found within a heterogeneous population of nucleic acid molecules. A "target sequence" is synonymous with a "test sequence".

An exemplary nucleotide sequence employed for hybridization studies or assays includes probe sequences that are complementary to or mimic in some embodiments at least an about 14 to 40 nucleotide sequence of a nucleic acid molecule of the presently disclosed subject matter. In one example, probes comprise 14 to 20 nucleotides, or even longer where desired, such as 30, 40, 50, 60, 100, 200, 300, or 500 nucleotides or up to the full length (for example, the full complement) of any of the nucleic acid sequence set forth in the odd numbered SEQ ID NOs: 1-195. Such fragments can be readily prepared by, for example, directly synthesizing the fragment by chemical synthesis, by application of nucleic acid amplification technology, or by introducing selected sequences into recombinant vectors for recombinant production.

The phrase "hybridizing substantially to" refers to complementary hybridization between a probe nucleic acid molecule and a target nucleic acid molecule and embraces minor mismatches (for example, polymorphisms) that can be accommodated by reducing the stringency of the hybridization and/or wash media to achieve the desired hybridization.

"Stringent hybridization conditions" and "stringent hybridization wash conditions" in the context of nucleic acid hybridization experiments such as Southern and Northern blot analyses, are both sequence- and environment-dependent. Longer sequences hybridize specifically at higher temperatures. An extensive guide to the hybridization of nucleic acids is found in Tijssen, 1993. Generally, high stringency hybridization and wash conditions are selected to be about 5° C. lower than the thermal melting point ($T_m$) for the specific sequence at a defined ionic strength and pH. Typically, under "highly stringent conditions" a probe will hybridize specifically to its target subsequence, but to no other sequences. Similarly, medium stringency hybridization and wash conditions are selected to be more than about 5° C. lower than the $T_m$ for the specific sequence at a defined ionic strength and pH. Exemplary medium stringency conditions include hybridizations and washes as for high stringency conditions, except that the temperatures for the hybridization and washes are in some embodiments 8° C., in some embodiments 10° C., in some embodiments 12° C., and in some embodiments 15° C. lower than the $T_m$ for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of highly stringent hybridization conditions for Southern or Northern Blot analysis of complementary nucleic acids having more than about 100 complementary residues is overnight hybridization in 6×SSC (or 6×SSPE)/0.5% SDS at 65° C., or the same solution including 50% formamide at 42° C. An example of highly stringent wash conditions is 15 minutes in 0.1× standard saline citrate (SSC), 0.1% (w/v) SDS at 65° C. Another example of highly stringent wash conditions is 15 minutes in 0.2×SSC buffer at 65° C. (see Sambrook and Russell, 2001 for a description of SSC buffer and other stringency conditions). Often, a high stringency wash is preceded by a lower stringency wash to remove background probe signal. An example of medium stringency wash conditions for a duplex of more than about 100 nucleotides is 15 minutes in 1×SSC at 55° C. Another example of medium stringency wash conditions for a duplex of more than about 100 nucleotides is 15 minutes in 1×SSC at 50° C. Another example of medium stringency wash conditions for a duplex of more than about 100 nucleotides is 15 minutes in 1×SSC at 45° C. An example of medium stringency wash conditions for a duplex of more than about 100 nucleotides is 15 minutes in 1×SSC at 40° C. Another example of medium stringency wash for a duplex of more than about 100 nucleotides is 15 minutes in 4-6×SSC at 40° C. Another example of medium stringency wash for a duplex of more than about 100 nucleotides is 15 minutes in 4-6×SSC at 40° C. For short probes (e.g., about 10 to 50 nucleotides), stringent conditions typically involve salt concentrations of less than about 1M $Na^+$ ion, typically about 0.01 to 1M $Na^+$ ion concentration (or other salts) at pH 7.0-8.3, and the temperature is typically at least about 30° C. Stringent conditions can also be achieved with the addition of destabilizing agents such as formamide. In general, a signal to noise ratio of 2-fold (or higher) than that observed for an unrelated probe in the particular hybridization assay indicates detection of a specific hybridization.

The following are examples of hybridization and wash conditions that can be used to clone homologous nucleotide sequences that are substantially identical to reference nucleotide sequences of the presently disclosed subject matter: a probe nucleotide sequence hybridizes in one example to a target nucleotide sequence in 7% sodium dodecyl sulfate (NaDS), 0.5M $NaPO_4$, 1 mm ethylene diamine tetraacetic acid (EDTA), 1% BSA at 50° C. followed by washing in 2×SSC, 0.1% NaDS at 50° C.; in another example, a probe and target sequence hybridize in 7% NaDS, 0.5 M $NaPO_4$, 1 mm EDTA, 1% BSA at 50° C. followed by washing in 1×SSC, 0.1% NaDS at 50° C.; in another example, a probe and target sequence hybridize in 7% NaDS, 0.5 M $NaPO_4$, 1 mm EDTA, 1% BSA at 50° C. followed by washing in 0.5× SSC, 0.1% NaDS at 50° C.; in another example, a probe and target sequence hybridize in 7% NaDS, 0.5 M $NaPO_4$, 1 mm EDTA, 1% BSA at 50° C. followed by washing in 0.1×SSC, 0.1% NaDS at 50° C.; in yet another example, a probe and target sequence hybridize in 7% NaDS, 0.5 M $NaPO_4$, 1 mm EDTA, 1% BSA at 50° C. followed by washing in 0.1×SSC, 0.1% NaDS at 65° C. In some embodiments, hybridization conditions comprise hybridization in a roller tube for at least 12 hours at 42° C. In each of the above conditions, the sodium phosphate hybridization buffer can be replaced by a hybridization buffer comprising 6×SSC (or 6×SSPE), 5×Denhardt's reagent, 0.5% NaDS, and 100 g/ml carrier DNA, including 0-50% formamide, with hybridization and wash temperatures chosen based upon the desired stringency. Other hybridization and wash conditions are known to those of skill in the art (see also Sambrook and Russell, 2001; Ausubel et al., 2002; and Ausubel et al., 2003, each of which is incorporated herein in its entirety). As is known in the art, the addition of formamide in the hybridization solution reduces the $T_m$ by about 0.4° C. Thus, high stringency conditions include the use of any of the above solutions and 0% formamide at 65° C., or any of the above solutions plus 50% formamide at 42° C.

As used herein, the term "pre-polypeptide" refers to a polypeptide that is normally targeted to a cellular organelle, such as a chloroplast, and still comprises a transit peptide.

As used herein, the terms "purified" and "isolated", when applied to a nucleic acid or polypeptide, denotes that the nucleic acid or polypeptide is essentially free of other cellular components with which it is associated in the natural state. It can be in a homogeneous state although it can be in either a dry or aqueous solution. Purity and homogeneity are typically determined using analytical chemistry techniques such as polyacrylamide gel electrophoresis or high performance liquid chromatography. A polypeptide that is the predominant species present in a preparation is substantially purified. The term "purified" denotes that a nucleic acid or polypeptide gives rise to essentially one band in an electrophoretic gel. Particularly, it means that the nucleic acid or polypeptide is in some embodiments at least about 50% pure, in some embodiments at least about 85% pure, and in some embodiments at least about 99% pure.

Two nucleic acids are "recombined" when sequences from each of the two nucleic acids are combined in a progeny nucleic acid. Two sequences are "directly" recombined when both of the nucleic acids are substrates for recombination. Two sequences are "indirectly recombined" when the sequences are recombined using an intermediate such as a cross-over oligonucleotide. For indirect recombination, no more than one of the sequences is an actual substrate for recombination, and in some cases, neither sequence is a substrate for recombination.

As used herein, the term "regulatory elements" refers to nucleotide sequences involved in controlling the expression of a nucleotide sequence. Regulatory elements can comprise a promoter operatively linked to the nucleotide sequence of interest and termination signals. Regulatory sequences also include enhancers and silencers. They also typically encompass sequences required for proper translation of the nucleotide sequence.

As used herein, the term "significant increase" refers to an increase in activity (for example, enzymatic activity) that is larger than the margin of error inherent in the measurement technique, in some embodiments an increase by about 2-fold or greater over a baseline activity (for example, the activity of the wild-type enzyme in the presence of the inhibitor), in some embodiments an increase by about 5-fold or greater, and in some embodiments an increase by about 10-fold or greater.

As used herein, the terms "significantly less" and "significantly reduced" refer to a result (for example, an amount of a product of an enzymatic reaction) that is reduced by more than the margin of error inherent in the measurement technique, in some embodiments a decrease by about 2-fold or greater with respect to a baseline activity (for example, the activity of the wild-type enzyme in the absence of the inhibitor), in some embodiments, a decrease by about 5-fold or greater, and in some embodiments a decrease by about 10-fold or greater.

As used herein, the terms "specific binding" and "immunological cross-reactivity" refer to an indicator that two molecules are substantially identical. An indication that two nucleic acid sequences or polypeptides are substantially identical is that the polypeptide encoded by the first nucleic acid is immunologically cross reactive with, or specifically binds to, the polypeptide encoded by the second nucleic acid. Thus, a polypeptide is typically substantially identical to a second polypeptide, for example, where the two polypeptides differ only by conservative substitutions.

The phrase "specifically (or selectively) binds to an antibody", or "specifically (or selectively) immunoreactive with", when referring to a polypeptide or peptide, refers to a binding reaction which is determinative of the presence of the polypeptide in the presence of a heterogeneous population of polypeptides and other biologics. Thus, under designated immunoassay conditions, the specified antibodies bind to a particular polypeptide and do not bind in a significant amount to other polypeptides present in the sample. Specific binding to an antibody under such conditions can require an antibody that is selected for its specificity for a particular polypeptide. For example, antibodies raised to the polypeptide with the amino acid sequence encoded by any of the nucleic acid sequences of the presently disclosed subject matter can be selected to obtain antibodies specifically immunoreactive with that polypeptide and not with other polypeptides except for polymorphic variants. A variety of immunoassay formats can be used to select antibodies specifically immunoreactive with a particular polypeptide. For example, solid-phase ELISA immunoassays, Western blots, or immunohistochemistry are routinely used to select monoclonal antibodies specifically immunoreactive with a polypeptide. See Harlow & Lane, 1988, for a description of immunoassay formats and conditions that can be used to determine specific immunoreactivity. Typically a specific or selective reaction will be at least twice background signal or noise and more typically more than 10 to 100 times background.

As used herein, the term "subsequence" refers to a sequence of nucleic acids or amino acids that comprises a part of a longer sequence of nucleic acids or amino acids (e.g., polypeptide), respectively.

As used herein, the term "substrate" refers to a molecule that an enzyme naturally recognizes and converts to a product in the biochemical pathway in which the enzyme naturally carries out its function; or is a modified version of the molecule, which is also recognized by the enzyme and is converted by the enzyme to a product in an enzymatic reaction similar to the naturally-occurring reaction.

As used herein, the term "suitable growth conditions" refers to growth conditions that are suitable for a certain desired outcome, for example, the production of a recombinant polypeptide or the expression of a nucleic acid molecule.

As used herein, the term "transformation" refers to a process for introducing heterologous DNA into a plant cell, plant tissue, or plant. Transformed plant cells, plant tissue, or plants are understood to encompass not only the end product of a transformation process, but also transgenic progeny thereof.

As used herein, the terms "transformed", "transgenic", and "recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed", "non-transgenic", or "non-recombinant" host refers to a wild-type organism, e.g., a bacterium or plant, which does not contain the heterologous nucleic acid molecule.

As used herein, the term "viability" refers to a fitness parameter of a plant. Plants are assayed for their homozygous performance of plant development, indicating which polypeptides are essential for plant growth.

III. NUCLEIC ACID MOLECULES AND POLYPEPTIDES

The presently disclosed subject matter encompasses the identification and isolation of cDNAs encoding genes of interest in the expression of abiotic stress tolerance. Abiotic stresses include, but are not limited to, cold, heat, drought, and salt stress, and can significantly affect the growth and/or yield of plants. In some embodiments, an abiotic stress is drought. Altering the expression of genes related to these traits can be used to improve or modify the rice plants, grain, or both plants and grain, as desired. Examples describe the isolated genes of interest and methods of analyzing the alteration of expression and their effects on the plant characteristics.

A. Nucleic Acid Molecules

Embodiments of the presently disclosed subject matter encompass isolated nucleic acid molecules corresponding to genes that are differentially regulated in rice in response to abiotic stress (for example, drought). In some embodiments, an isolated nucleic acid molecule of the presently disclosed subject matter comprises a nucleotide sequence set forth in odd numbered sequences SEQ ID NOs: 1-195, or a functional fragment, domain, or feature thereof. In some embodiments, an isolated nucleic acid molecule of the presently disclosed subject matter comprises a nucleotide sequence having substantial identity to a nucleotide sequence set forth in odd numbered sequences SEQ ID NOs: 1-195, or a functional fragment, domain, or feature thereof. Another embodiment of the presently disclosed subject matter encompasses an isolated nucleic acid molecule comprising a nucleotide sequence that is complementary to, or the reverse complement of, a nucleotide sequence listed in odd numbered sequences of SEQ ID NOs: 1-195, or a functional fragment, domain, or feature thereof. Some embodiments of the presently disclosed subject matter encompass an isolated nucleic acid molecule comprising a nucleotide sequence that is complementary to, or the reverse complement of, a nucleotide sequence that has substantial identity to, or is capable of hybridizing to, a nucleotide sequence listed in odd numbered sequences of SEQ ID NOs: 1-195, or a functional fragment, domain, or feature thereof.

In some embodiments, the substantial identity is at least about 60% identity, in some embodiments at least about 65% identity, in some embodiments at least about 70% identity, in some embodiments at least about 75% identity, in some embodiments at least about 80% identity, in some embodiments at least about 85% identity, in some embodiments at least about 90% identity, in some embodiments at least about 91% identity, in some embodiments at least about 92% identity, in some embodiments at least about 93% identity, in some embodiments at least about 94% identity, in some embodiments at least about 95% identity, in some embodiments at least about 96% acid identity, in some embodiments at least about 97% identity, in some embodiments at least about 98% identity, in some embodiments at least about 99% identity, and in some embodiments about 100% identity to the nucleotide sequence listed in odd numbered sequences of SEQ ID NOs: 1-195, or a functional fragment, domain, or feature thereof.

In some embodiments, the nucleotide sequence having substantial identity comprises an allelic variant of the nucleotide sequence listed in odd numbered sequences of SEQ ID NOs: 1-195, or a functional fragment, domain, or feature thereof. In some embodiments, the nucleotide sequence having substantial identity comprises a naturally occurring variant. In some embodiments, the nucleotide sequence having substantial identity comprises a polymorphic variant of the nucleotide sequence listed in odd numbered sequences of SEQ ID NOs: 1-195, or a functional fragment, domain, or feature thereof.

In some embodiments, the nucleic acid having substantial identity comprises a deletion or insertion of at least one nucleotide. In some embodiments, the deletion or insertion comprises less than about thirty nucleotides. In some embodiments, the deletion or insertion comprises less than about five nucleotides. In some embodiments, the sequence of the isolated nucleic acid having substantial identity comprises a substitution in at least one codon. In some embodiments, the substitution is conservative.

In some embodiments, the isolated nucleic acid comprises a nucleotide sequence capable of hybridizing to a nucleotide sequence listed in odd numbered sequences of SEQ ID NOs: 1-195, or a functional fragment, domain, or feature thereof. In some embodiments, hybridization allows the sequence to form a duplex at medium or high stringency.

In some embodiments, the isolated nucleic acid comprises a plurality of regions having a nucleotide sequence listed in odd numbered sequences of SEQ ID NOs: 1-195, or an exon, domain, or feature thereof.

In some embodiments, the sequence having substantial identity to the nucleotide sequence listed in odd numbered sequences of SEQ ID NOs: 1-195, or a functional fragment, domain, or feature thereof, is from a plant. In some embodiments, the plant is a dicot. In some embodiments, the plant is a gymnosperm. In some embodiments, the plant is a monocot. In some embodiments, the monocot is a cereal. In some embodiments, the cereal can be, for example, maize, wheat, barley, oats, rye, millet, sorghum, triticale, *secale*, einkorn, spelt, emmer, teff, milo, flax, gramma grass, *Tripsacum* sp., or teosinte. In some embodiments, the cereal is rice.

In some embodiments, the nucleic acid is expressed in a specific location or tissue of a plant. In some embodiments, the location or tissue includes, but is not limited to, epidermis, root, vascular tissue, meristem, cambium, cortex, pith, leaf, flower, and combinations thereof. In some embodiments, the location or tissue is a seed.

In some embodiments, the nucleic acid encodes a polypeptide involved in a function including, but not limited to, carbon metabolism, photosynthesis, signal transduction, cell growth, reproduction, disease processes, gene regulation, and differentiation. In some embodiments, the nucleic acid encodes a polypeptide involved in abiotic stress tolerance, enhanced yield, disease resistance, or nutritional content.

As used herein, the phrase "involved in" in reference to a gene or gene product is means that the gene or gene product functions in a particular biochemical pathway or reaction. By way of example, the gene or protein glucose-6-phosphate dehydrogenase is involved in (i.e. functions) in glucose metabolism.

Embodiments of the presently disclosed subject matter further relate to an isolated polynucleotide comprising a nucleotide sequence of at least 10 bases, which sequence is identical, complementary (for example, fully complementary), or substantially identical to a region of any sequence of odd numbered sequences of SEQ ID NOs: 1-195, and wherein the polynucleotide is adapted for any of numerous uses.

In some embodiments, the polynucleotide is used as a chromosomal marker. In some embodiments, the polynucleotide is used as a marker for restriction fragment length polymorphism (RFLP) analysis. In some embodiments, the polynucleotide is used as a marker for quantitative trait-linked analysis and/or breeding. In some embodiments, the polynucleotide is used as a marker for marker-assisted breeding. In some embodiments, the polynucleotide is used as a bait sequence in a two-hybrid system to identify sequence-encoding polypeptides interacting with the polypeptide encoded by the bait sequence. In some embodiments, the polynucleotide is used as a diagnostic indicator for genotyping or identifying an individual or population of individuals. In some embodiments, the polynucleotide is used for genetic analysis to identify boundaries of genes or exons.

Embodiments of the presently disclosed subject matter also relate to a shuffled nucleic acid molecule comprising a plurality of nucleotide sequence fragments, wherein at least one of the fragments corresponds to a region of a nucleotide sequence listed in odd numbered sequences of SEQ ID NOs: 1-195, and wherein at least two of the plurality of sequence fragments are in an order, from 5' to 3', which is not an order in which the plurality of fragments naturally occur. In some embodiments, all of the fragments in a shuffled nucleic acid comprising a plurality of nucleotide sequence fragments are from a single gene. In some embodiments, the plurality of fragments is derived from at least two different genes. In some embodiments, the shuffled nucleic acid is operatively linked to a promoter sequence. In some embodiments, the shuffled nucleic acid comprises a chimeric polynucleotide comprising a promoter sequence operatively linked to the shuffled nucleic acid. In some embodiments, the shuffled nucleic acid is contained within a host cell.

B. Identifying, Cloning, and Sequencing cDNAs

The cloning and sequencing of the cDNAs of the presently disclosed subject matter can be accomplished using techniques known in the art. See generally, Silhavy et al., 1984; Reiter et al., 1992; Schultz et al., 1998; Sambrook & Russell, 2001; Ausubel et al., 2002; and Ausubel et al., 2003.

The isolated nucleic acids and polypeptides of the presently disclosed subject matter are usable over a range of plants—both monocots and dicots—in particular monocots such as rice, wheat, barley, and maize. In some embodiments, the monocot is a cereal. In some embodiments, the cereal can be, for example, maize, wheat, barley, oats, rye, millet, sorghum, triticale, *secale*, einkorn, spelt, emmer, teff, milo, flax, gramma grass, *Tripsacum* sp., or teosinte. In some embodiments, the cereal is rice. Other plant genera relevant to the presently disclosed subject matter include, but are not limited to *Cucurbita, Rosa, Vitis, Juglans, Gragaria, Lotus, Medicago, Onobrychis, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersicon, Nicotiana, Solanum, Petunia, Digitalis, Majorana, Ciahorium, Helianthus, Lactuca, Bromus, Asparagus, Antirrhinum, Heterocallis, Nemesis, Pelargonium, Panieum, Pennisetum, Ranunculus, Senecio, Salpiglossis, Cucumis, Browaalia, Glycine, Pisum, Phaseolus, Lolium, Oryza, Avena, Hordeum, Secale, Allium,* and *Triticum*.

The presently disclosed subject matter also provides a method for genotyping a plant or plant part comprising a nucleic acid molecule of the presently disclosed subject matter. Optionally, the plant is a monocot such as, but not limited to, rice or wheat. Genotyping provides a methodology for distinguishing homologs of a chromosome pair and can be used to differentiate segregants in a plant population. Molecular marker methods can be used in phylogenetic studies, characterizing genetic relationships among crop varieties, identifying crosses or somatic hybrids, localizing chromosomal segments affecting monogenic traits, mapping based cloning, and the study of quantitative inheritance (see Clark, 1997; Paterson, 1996).

The method for genotyping can employ any number of molecular marker analytical techniques including, but not limited to, restriction length polymorphisms (RFLPs). As is well known in the art, RFLPs are produced by differences in the DNA restriction fragment lengths resulting from nucleotide differences between alleles of the same gene. Thus, the presently disclosed subject matter provides a method for following segregation of a gene or nucleic acid of the presently disclosed subject matter or chromosomal sequences genetically linked by using RFLP analysis. Linked chromosomal sequences are in some embodiments within 50 centimorgans (cM), in some embodiments within 40 cM, in some embodiments within 30 cM, in some embodiments within 20 cM, in some embodiments within 10 cM, and in some embodiments within 5, 3, 2, or 1 cM of the nucleic acid of the presently disclosed subject matter.

Embodiments of the presently disclosed subject matter also relate to an isolated nucleic acid molecule comprising a nucleotide sequence, its complement (for example, its full complement), or its reverse complement (for example, its full reverse complement), the nucleotide sequence encoding a polypeptide (for example, a biologically active polypeptide). In some embodiments, the nucleotide sequence encodes a polypeptide comprising a polypeptide sequence listed in even numbered sequences of SEQ ID NOs: 2-196, or a functional fragment, domain, repeat, feature, or chimera thereof. In some embodiments, the nucleotide sequence encodes a polypeptide comprising a polypeptide sequence having substantial identity to a polypeptide sequence listed in even numbered sequences of SEQ ID NOs: 2-196, or a functional fragment, domain, repeat, feature, or chimera thereof. In some embodiments, the nucleotide sequence encodes a polypeptide comprising a polypeptide sequence encoded by a nucleotide sequence identical to or having substantial identity to a nucleotide sequence listed in odd numbered sequences of SEQ ID NOs: 1-195, or a functional fragment, domain, or feature thereof, or a sequence complementary thereto. In some embodiments, the nucleotide sequence encodes a polypeptide comprising a polypeptide sequence encoded by a nucleotide sequence capable of hybridizing under medium stringency conditions to a nucleotide sequence listed in odd numbered sequences of SEQ ID NOs: 1-195, or to a sequence complementary thereto. In some embodiments, the nucleotide sequence encodes a functional fragment of a polypeptide of the presently disclosed subject matter.

In some embodiments, the isolated nucleic acid comprises a polypeptide-encoding sequence. In some embodiments, the polypeptide-encoding sequence encodes a polypeptide comprising a polypeptide sequence listed in even numbered sequences of SEQ ID NOs: 2-196, or a functional fragment thereof. In some embodiments, the polypeptide-encoding sequence comprises a 20 base pair nucleotide portion identical in sequence to a consecutive 20 base pair nucleotide portion of a nucleic acid sequence listed in odd numbered sequences of SEQ ID NOs: 1-195. In some embodiments, the polypeptide comprises a polypeptide disclosed in Tables 4 and 6. In some embodiments, the polypeptide is a plant polypeptide. In some embodiments, the plant is a dicot. In some embodiments, the plant is a gymnosperm. In some embodiments, the plant is a monocot. In some embodiments, the monocot is a cereal. In some embodiments, the cereal includes, but is not limited to, maize, wheat, barley, oats, rye, millet, sorghum, triticale, *secale*, einkorn, spelt, emmer, teff, miloflax, gramma grass, *Tripsacum*, and teosinte. In some embodiments, the cereal is rice.

In some embodiments, the polypeptide is involved in a function such as abiotic stress tolerance, enhanced yield, disease resistance, or nutritional content. In some embodiments, the polypeptide is involved in drought resistance.

Embodiments of the presently disclosed subject matter also relate to an isolated nucleic acid molecule comprising a nucleotide sequence, its complement (for example, its full complement), or its reverse complement (for example, its full reverse complement), encoding a polypeptide selected from the group consisting of:

(a) a polypeptide sequence listed in even numbered sequences of SEQ ID NOs: 2-196, or a functional fragment, domain, repeat, feature, or chimera thereof;

(b) a polypeptide sequence having substantial identity to (a);

(c) a polypeptide having an amino acid sequence that is at least 60% identical to and having a same function as a polypeptide having an amino acid sequence of one of even numbered SEQ ID NOs: 2-196 (e.g. the same polypeptide having an amino acid sequence of one of even numbered of SEQ ID NO: 2-196 to which it has at least 60% identity);

(d) a polypeptide sequence encoded by a nucleotide sequence identical to or having substantial identity to a nucleotide sequence listed in odd numbered sequences of SEQ ID NOs: 1-195, or a functional fragment, domain, or feature thereof, or a sequence complementary thereto;

(e) a polypeptide sequence encoded by a nucleotide sequence capable of hybridizing under medium stringency conditions to a nucleotide sequence listed in odd numbered sequences of SEQ ID NOs: 1-195, or to a sequence complementary thereto; and (f) a functional fragment of (a), (b), (c) or (d).

In some embodiments, the polypeptide having substantial identity comprises an allelic variant of a polypeptide sequence listed in even numbered sequences of SEQ ID NOs: 2-196, or a functional fragment, domain, repeat, feature, or chimera thereof. In some embodiments, the isolated nucleic acid comprises a plurality of regions from the polypeptide sequence encoded by a nucleotide sequence identical to or having substantial identity to a nucleotide sequence listed in odd numbered sequences of SEQ ID NOs: 1-195, or a functional fragment, domain, or feature thereof, or a sequence complementary thereto.

In some embodiments, the sequence of the isolated nucleic acid encodes a polypeptide useful for generating an antibody having immunoreactivity against a polypeptide encoded by a nucleotide sequence listed in odd numbered sequences of SEQ ID NOs: 1-195, or a functional fragment, domain, or feature thereof.

C. Polypeptides

The presently disclosed subject matter further relates to isolated polypeptides comprising the amino acid sequences set forth in even numbered SEQ ID NOs: 2-196, including biologically active polypeptides. In some embodiments, the polypeptide comprises a polypeptide sequence listed in even numbered sequences of SEQ ID NOs: 2-196. In some embodiments, the polypeptide comprises a functional fragment or domain of a polypeptide sequence listed in even numbered sequences of SEQ ID NOs: 2-196. In some embodiments, the polypeptide comprises a chimera of a polypeptide sequence listed in even numbered sequences of SEQ ID NOs: 2-196, where the chimera can comprise functional polypeptide motifs, including domains, repeats, post-translational modification sites, or other features. In some embodiments, the polypeptide is a plant polypeptide. In some embodiments, the plant is a dicot. In some embodiments, the plant is a gymnosperm. In some embodiments, the plant is a monocot. In some embodiments, the monocot is a cereal. In some embodiments, the cereal is, for example, maize, wheat, barley, oats, rye, millet, sorghum, triticale, *secale*, einkorn, spelt, emmer, teff, milo, flax, gramma grass, *Tripsacum*, or teosinte. In some embodiments, the cereal is rice.

In some embodiments, the polypeptide is expressed in a specific location or tissue of a plant. In some embodiments, the location or tissue includes, but is not limited to, epidermis, root, vascular tissue, meristem, cambium, cortex, pith, leaf, flower, and combinations thereof. In some embodiments, the location or tissue is a seed.

In some embodiments, the polypeptide is involved in a function such as abiotic stress tolerance, disease resistance, enhanced yield or nutritional quality or composition. In some embodiments, the polypeptide is involved in drought resistance.

In some embodiments, isolated polypeptides comprise the amino acid sequences set forth in even numbered SEQ ID NOs: 2-196, and variants having conservative amino acid modifications. The term "conservative modified variants" refers to polypeptides that can be encoded by nucleic acid sequences having degenerate codon substitutions wherein at least one position of one or more selected (or all) codons is substituted with mixed-base and/or deoxyinosine residues (Batzer et al., 1991; Ohtsuka et al., 1985; Rossolini et al., 1994). Additionally, one skilled in the art will recognize that individual substitutions, deletions, or additions to a nucleic acid, peptide, polypeptide, or polypeptide sequence that alters, adds, or deletes a single amino acid or a small percentage of amino acids in the encoded sequence is a "conservative modification" where the modification results in the substitution of an amino acid with a chemically similar amino acid. Conservative modified variants provide similar biological activity as the unmodified polypeptide. Conservative substitution tables listing functionally similar amino acids are known in the art. See Creighton, 1984.

The term "conservatively modified variant" also refers to a peptide having an amino acid residue sequence substantially identical to a sequence of a polypeptide of the presently disclosed subject matter in which one or more residues have been conservatively substituted with a functionally similar residue. Examples of conservative substitutions include the substitution of one non-polar (hydrophobic) residue such as isoleucine, valine, leucine or methionine for another; the substitution of one polar (hydrophilic) residue for another such as between arginine and lysine, between glutamine and asparagine, between glycine and serine; the substitution of one basic residue such as lysine, arginine or histidine for another; or the substitution of one acidic residue, such as aspartic acid or glutamic acid for another.

Amino acid substitutions, such as those which might be employed in modifying the polypeptides described herein, are generally based on the relative similarity of the amino acid side-chain substituents, for example, their hydrophobicity, hydrophilicity, charge, size, and the like. An analysis of the size, shape, and type of the amino acid side-chain substituents reveals that arginine, lysine, and histidine are all positively charged residues; that alanine, glycine, and serine are all of similar size; and that phenylalanine, tryptophan, and tyrosine all have a generally similar shape. Therefore, based upon these considerations, arginine, lysine and histidine; alanine, glycine and serine; and phenylalanine, tryptophan and tyrosine; are defined herein as biologically functional equivalents. Other biologically functionally equivalent changes will be appreciated by those of skill in the art.

In making biologically functional equivalent amino acid substitutions, the hydropathic index of amino acids can be considered. Each amino acid has been assigned a hydropathic index on the basis of their hydrophobicity and charge characteristics, these are: isoleucine (+4.5); valine (+4.2); leucine (+3.8); phenylalanine (+2.8); cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is generally understood in the art (Kyte & Doolittle, 1982, incorporated herein by reference). It is known that certain amino acids can be substituted for other amino acids having a similar hydropathic index or score and still retain a similar biological activity. Substitutions of amino acids involve amino acids for which the hydropathic indices are in some embodiments within ±2 of the original value, in some embodiments within ±1 of the original value, and in some embodiments within ±0.5 of the original value in making changes based upon the hydropathic index.

It is also understood in the art that the substitution of like amino acids can be made effectively on the basis of hydrophilicity. U.S. Pat. No. 4,554,101, incorporated herein by reference, states that the greatest local average hydrophilicity of a protein, as governed by the hydrophilicity of its adjacent amino acids, correlates with its immunogenicity and antigenicity, i.e. with a biological property of the protein. It is understood that an amino acid can be substituted for another having a similar hydrophilicity value and still obtain a biologically equivalent protein.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Substitutions of amino acids involve amino acids for which the hydrophilicity values are in some embodiments within ±2 of the original value, in some embodiments within ±1 of the original value, and in some embodiments within ±0.5 of the original value in making changes based upon similar hydrophilicity values.

While discussion has focused on functionally equivalent polypeptides arising from amino acid changes, it will be appreciated that these changes can be effected by alteration of the encoding DNA, taking into consideration also that the genetic code is degenerate and that two or more codons can code for the same amino acid.

In an alternative embodiment, the sequence having substantial identity contains a deletion or insertion of at least one amino acid. In some embodiments, the deletion or insertion is of less than about ten amino acids. In some embodiments, the deletion or insertion is of less than about three amino acids.

In some embodiments, the sequence having substantial identity encodes a substitution in at least one amino acid.

Embodiments of the presently disclosed subject matter also provide an isolated polypeptide comprising a polypeptide sequence selected from the group consisting of:
  (a) a polypeptide sequence listed in even numbered SEQ ID NO: 2-196, or a domain or feature thereof;
  (b) a polypeptide sequence having substantial identity to (a);
  (c) a polypeptide having an amino acid sequence that is at least 60% identical to and having a same function as a polypeptide having an amino acid sequence of one of even numbered SEQ ID NOs: 2-196 (e.g. the same polypeptide having an amino acid sequence of one of even numbered of SEQ ID NO: 2-196 to which it has at least 60% identity);
  (d) a polypeptide sequence encoded by a nucleotide sequence identical to or having substantial identity to a nucleotide sequence listed in odd numbered SEQ ID NO: 1-195, or an exon, domain, or feature thereof, or a sequence complementary thereto;
  (e) a polypeptide sequence encoded by a nucleotide sequence capable of hybridizing under medium stringency conditions to a nucleotide sequence listed in odd numbered SEQ ID NO: 1-195, or to a sequence complementary thereto; and
  (f) a functional fragment of (a), (b), (c) or (d).

In some embodiments, a polypeptide having substantial identity to a polypeptide sequence listed in even numbered SEQ ID NO: 2-196, or a domain or feature thereof, is an allelic variant of the polypeptide sequence listed in even numbered SEQ ID NO: 2-196. In some embodiments, a polypeptide having substantial identity to a polypeptide sequence listed in even numbered SEQ ID NO: 2-196, or a domain or feature thereof, is a naturally occurring variant of the polypeptide sequence listed in even numbered SEQ ID NO: 2-196. In some embodiments, a polypeptide having substantial identity to a polypeptide sequence listed in even numbered SEQ ID NO: 2-196, or a domain or feature thereof, is a polymorphic variant of the polypeptide sequence listed in even numbered SEQ ID NO: 2-196.

In some embodiments, the polypeptide is a polypeptide comprising one of the amino acid sequences listed in even numbered SEQ ID NO: 2-196. In some embodiments, the polypeptide is a functional fragment or domain of a polypeptide comprising one of the amino acid sequences listed in even numbered SEQ ID NOs: 2-196. In some embodiments, the polypeptide is a chimera, where the chimera comprises a functional polypeptide domain, including, but not limited to, a domain, a repeat, a post-translational modification site, and combinations thereof. In some embodiments, the polypeptide is a plant polypeptide. In some embodiments, the plant is a dicot. In some embodiments, the plant is a gymnosperm. In some embodiments, the plant is a monocot. In some embodiments, the monocot is a cereal. In some embodiments, the cereal can be, for example, maize, wheat, barley, oats, rye, millet, sorghum, triticale, *secale*, einkorn, spelt, emmer, teff, milo, flax, gramma grass, *Tripsacum*, or *teosinte*. In some embodiments, the cereal is rice.

In some embodiments, the polypeptide is expressed in a specific location or tissue of a plant. In some embodiments, the location or tissue includes, but is not limited to, epidermis, vascular tissue, meristem, cambium, cortex, or pith. In some embodiments, the location or tissue is leaf or sheath, root, flower, and developing ovule or seed. In some embodiments, the location or tissue can be, for example, epidermis, root, vascular tissue, meristem, cambium, cortex, pith, leaf, or flower. In some embodiments, the location or tissue is a seed.

In some embodiments, the polypeptide sequence is encoded by a nucleotide sequence having substantial identity to a nucleotide sequence listed in odd numbered SEQ ID NO: 1-195 or a functional fragment, domain, or feature thereof or a sequence complementary thereto, wherein the nucleotide sequence includes a deletion or insertion of at least one nucleotide. In some embodiments, the deletion or insertion is of less than about thirty nucleotides. In some embodiments, the deletion or insertion is of less than about five nucleotides. In some embodiments, the polypeptide sequence encoded by a nucleotide sequence having substantial identity to a nucleotide sequence listed in odd numbered SEQ ID NO: 1-195, or a functional fragment, domain, or feature thereof or a sequence complementary thereto, includes a substitution of at least one codon. In some embodiments, the substitution is conservative. In some embodiments, the polypeptide sequences having substantial identity to the polypeptide sequence listed in even numbered SEQ ID NO: 2-196, or a functional fragment, domain, repeat, feature, or chimera thereof, includes a deletion or insertion of at least one amino acid.

The polypeptides of the presently disclosed subject matter, fragments thereof, or variants thereof, can comprise any number of contiguous amino acid residues from a polypeptide of the presently disclosed subject matter, wherein the number of residues is selected from the group of integers consisting of from 10 to the number of residues in a full-length polypeptide of the presently disclosed subject matter. In some embodiments, the portion or fragment of the polypeptide is a functional polypeptide. The presently disclosed subject matter includes active polypeptides having specific activity of at least in some embodiments 20%, in some embodiments 30%, in some embodiments 40%, in some embodiments 50%, in some embodiments 60%, in some embodiments 70%, in some embodiments 80%, in some embodiments 90%, and in some embodiments 95% that of the native (non-synthetic) endogenous polypeptide. Further, the substrate specificity ($k_{cat}/K_m$) can be substantially identical to the native (non-synthetic), endogenous polypeptide. Typically the $K_m$ will be at least in some embodiments 30%, in some embodiments 40%, in some embodiments 50% of the native, endogenous polypeptide; and in some embodiments at least 60%, in some embodiments 70%, in some embodiments 80%, and in some embodiments 90% of the native, endogenous polypeptide. Methods of assaying and quantifying measures of activity and substrate specificity are well known to those of skill in the art.

The isolated polypeptides of the presently disclosed subject matter can elicit production of an antibody specifically reactive to a polypeptide of the presently disclosed subject matter when presented as an immunogen. Therefore, the polypeptides of the presently disclosed subject matter can be employed as immunogens for constructing antibodies immunoreactive to a polypeptide of the presently disclosed subject matter for such purposes including, but not limited to, immunoassays or polypeptide purification techniques. Immunoassays for determining binding are well known to those of skill in the art and include, but are not limited to, enzyme-linked immunosorbent assays (ELISAs) and competitive immunoassays.

Embodiments of the presently disclosed subject matter also relate to chimeric polypeptides encoded by the isolated nucleic acid molecules of the present disclosure including a chimeric polypeptide containing a polypeptide sequence encoded by an isolated nucleic acid containing a nucleotide sequence selected from the group consisting of:
   (a) a nucleotide sequence listed in odd numbered SEQ ID NO: 1-195, or an exon, domain, or feature thereof;
   (b) a nucleotide sequence having substantial identity to (a);
   (c) a nucleotide sequence at least about 60% identical to (a);
   (d) a nucleotide sequence capable of hybridizing to (a) under medium stringency;
   (e) a nucleotide sequence complementary (for example, fully complementary) to (a), (b) or (c); and
   (f) a nucleotide sequence which is the reverse complement (for example, full reverse complement) of (a), (b) or (c);
   (g) or a functional fragment thereof.

Also, a polypeptide containing a polypeptide sequence encoded by an isolated nucleic acid containing a nucleotide sequence, its complement, or its reverse complement, encoding a polypeptide including a polypeptide sequence including:
   (a) a polypeptide sequence listed in even numbered SEQ ID NO: 2-196, or a domain, repeat, feature, or chimeras thereof;
   (b) a polypeptide sequence having substantial identity to (a);
   (c) a polypeptide sequence encoded by a nucleotide sequence identical to or having substantial identity to a nucleotide sequence listed in odd numbered SEQ ID NO: 1-195, or a domain or feature thereof, or a sequence complementary thereto;
   (d) a polypeptide sequence encoded by a nucleotide sequence capable of hybridizing under medium stringency conditions to a nucleotide sequence listed in odd numbered SEQ ID NO: 1-195, or to a sequence complementary thereto; and
   (e) a functional fragment of (a), (b), (c) or (d).

IV. CONTROLLING AND ALTERING THE EXPRESSION OF NUCLEIC ACID MOLECULES

A. General Considerations

One aspect of the presently disclosed subject matter provides compositions and methods for altering (i.e. increasing or decreasing) the level of nucleic acid molecules and/or polypeptides of the presently disclosed subject matter in plants. In particular, the nucleic acid molecules and polypeptides of the presently disclosed subject matter are expressed constitutively, temporally, or spatially (e.g. at developmental stages), in certain tissues, and/or quantities, which are uncharacteristic of non-recombinantly engineered plants. Therefore, the presently disclosed subject matter provides utility in such exemplary applications as altering the specified characteristics identified above.

The isolated nucleic acid molecules of the presently disclosed subject matter are useful for expressing a polypeptide of the presently disclosed subject matter in a recombinantly engineered cell such as a bacterial, yeast, insect, mammalian, or plant cell. Expressing cells can produce the polypeptide in a non-natural condition (e.g. in quantity, composition, location and/or time) because they have been genetically altered to do so. Those skilled in the art are knowledgeable in the numerous expression systems available for expression of nucleic acids encoding a polypeptide of the presently disclosed subject matter.

Embodiments of the presently disclosed subject matter provide an expression cassette comprising a promoter sequence operatively linked to an isolated nucleic acid, the isolated nucleic acid comprising:
(a) a nucleotide sequence listed in odd numbered sequences of SEQ ID NOs: 1-195, or a functional fragment, domain, or feature thereof;
(b) a nucleotide sequence having substantial identity to (a);
(c) a nucleotide sequence at least 60% identical to (a);
(d) a nucleotide sequence capable of hybridizing to (a) under medium stringency;
(e) a nucleotide sequence complementary (for example, fully complementary) to (a), (b) or (c); and
(f) a nucleotide sequence which is the reverse complement (for example, the full reverse complement) of (a), (b) or (c).

Further encompassed within the presently disclosed subject matter is a recombinant vector comprising an expression cassette according to the embodiments of the presently disclosed subject matter. Also encompassed are plant cells comprising expression cassettes according to the present disclosure, and plants comprising these plant cells. In some embodiments, the plant is a dicot. In some embodiments, the plant is a gymnosperm. In some embodiments, the plant is a monocot. In some embodiments, the monocot is a cereal. In some embodiments, the cereal is, for example, maize, wheat, barley, oats, rye, millet, sorghum, triticale, *secale*, einkorn, spelt, emmer, teff, milo, flax, gramma grass, *Tripsacum* or *teosinte*. In some embodiments, the cereal is rice.

In some embodiments, the expression cassette is expressed throughout the plant. In some embodiments, the expression cassette is expressed in a specific location or tissue of a plant. In some embodiments, the location or tissue includes, but is not limited to, epidermis, root, vascular tissue, meristem, cambium, cortex, pith, leaf, flower, and combinations thereof. In some embodiments, the location or tissue is a seed.

In some embodiments, the expression cassette is involved in a function including, but not limited to, disease resistance, yield, abiotic stress resistance, nutritional quality, carbon metabolism, photosynthesis, signal transduction, cell growth, reproduction, disease processes (for example, pathogen resistance), gene regulation, and differentiation. In some embodiments, the chimeric polypeptide is involved in a function such as abiotic stress tolerance, enhanced yield, disease resistance, or nutritional composition. In some embodiments, the abiotic stress tolerance is drought resistance.

Embodiments of the presently disclosed subject matter also relate to an expression vector comprising a nucleic acid molecule selected from the group consisting of:
(a) a nucleic acid encoding a polypeptide as listed in even numbered sequences of SEQ ID NOs: 2-196;
(b) a functional fragment, domain, or featured region listed in odd numbered sequences of SEQ ID NOs: 1-195; and
(c) a complete nucleic acid sequence listed in odd numbered sequences of SEQ ID NOs: 1-195, or a functional fragment thereof, in combination with a heterologous sequence.

In some embodiments, the expression vector comprises one or more elements including, but not limited to, a promoter-enhancer sequence, a selection marker sequence, an origin of replication, an epitope tag-encoding sequence, and an affinity purification tag-encoding sequence. In some embodiments, the promoter-enhancer sequence comprises, for example, the cauliflower mosaic virus (CaMV) 35S promoter, the CaMV 19S promoter, the tobacco PR-1a promoter, the ubiquitin promoter, or the phaseolin promoter. In some embodiments, the promoter is operable in plants, and in some embodiments, the promoter is a constitutive or inducible promoter. In some embodiments, the selection marker sequence encodes an antibiotic resistance gene. In some embodiments, the epitope tag sequence encodes V5 (GKPIPNPLLGLDST; SEQ ID NO: 197; Southern et al., 1991), the peptide Phe-His-His-Thr-Thr (SEQ ID NO: 198), hemaglutinin, or glutathione-S-transferase. In some embodiments the affinity purification tag sequence encodes a polyamino acid sequence or a polypeptide. In some embodiments, the polyamino acid sequence comprises polyhistidine. In some embodiments, the polypeptide is chitin-binding domain or glutathione-S-transferase. In some embodiments, the affinity purification tag sequence comprises an intein encoding sequence.

In some embodiments, the expression vector comprises a eukaryotic expression vector, and in some embodiments, the expression vector comprises a prokaryotic expression vector. In some embodiments, the eukaryotic expression vector comprises a tissue-specific promoter. In some embodiments, the expression vector is operable in plants.

Embodiments of the presently disclosed subject matter also relate to a cell comprising a nucleic acid construct comprising an expression vector and a nucleic acid comprising a nucleic acid encoding a polypeptide as listed in even numbered sequences of SEQ ID NOs: 2-196, or a nucleic acid sequence listed in odd numbered sequences of SEQ ID NOs: 1-195, or a subsequence thereof, in combination with a heterologous sequence.

In some embodiments, the cell is a bacterial cell, a fungal cell, a plant cell, or an animal cell. In some embodiments, the polypeptide is expressed in a specific location or tissue of a plant. In some embodiments, the location or tissue includes, but is not limited to, epidermis, root, vascular tissue, meristem, cambium, cortex, pith, leaf, flower, and combinations thereof. In an alternative embodiment, the location or tissue is a seed. In some embodiments, the polypeptide is involved in a function such as, for example, carbon metabolism, photosynthesis, signal transduction, cell growth, reproduction, disease processes, gene regulation, and differentiation. In some embodiments, the polypeptide is involved in a function such as abiotic stress tolerance, enhanced yield, disease resistance, or nutritional composition.

Prokaryotic cells including, but not limited to, *Escherichia coli* and other microbial strains known to those in the art, can be used as host cells. Methods for expressing polypeptides in prokaryotic cells are well known to those in the art and can be found in many laboratory manuals such as Sambrook & Russell, 2001. A variety of promoters, ribosome binding sites, and operators to control expression are available to those skilled in the art, as are selectable markers such as antibiotic resistance genes. The type of vector is chosen to allow for optimal growth and expression in the selected cell type.

A variety of eukaryotic expression systems are available such as, for example, yeast, insect cell lines, plant cells, and mammalian cells. Expression and synthesis of heterologous polypeptides in yeast is well known (see Sherman et al., 1982). Yeast strains widely used for production of eukaryotic polypeptides are *Saccharomyces cerevisiae* and *Pichia pastoris*, and vectors, strains, and protocols for expression are available from commercial suppliers (e.g., Invitrogen Corp., Carlsbad, Calif., United States of America).

Mammalian cell systems can be transformed with expression vectors for production of polypeptides. Suitable host cell lines available to those in the art include, but are not limited to, the HEK293, BHK21, and CHO cells lines. Expression vectors for these cells can include expression control sequences such as an origin of replication, a promoter, (e.g., the CMV promoter, a Herpes Simplex Virus thymidine kinase (HSV-tk) promoter or phosphoglycerate kinase (pgk) promoter), an enhancer, and polypeptide processing sites such as ribosome binding sites, RNA splice sites, polyadenylation sites, and transcription terminator sequences. Other animal cell lines useful for the production of polypeptides are available commercially or from depositories such as the American Type Culture Collection (ATCC; Manassas, Va., United States of America).

Expression vectors for expressing polypeptides in insect cells are usually derived from baculovirus or other viruses known in the art. A number of suitable insect cell lines are available including, but not limited to, mosquito larvae, silkworm, armyworm (for example, *Spodoptera frugiperda*), moth, and *Drosophila* cell lines.

Methods of transforming animal and lower eukaryotic cells are known. Numerous methods can be used to introduce exogenous DNA into eukaryotic cells including, but not limited to, calcium phosphate precipitation, fusion of the recipient cell with bacterial protoplasts containing the DNA, treatment of the recipient cells with liposomes containing the DNA, DEAE dextrin, electroporation, biolistics, and microinjection of the DNA directly into the cells. Transformed cells are cultured using means well known in the art (see Kuchler, 1997).

Once a polypeptide of the presently disclosed subject matter is expressed it can be isolated and purified from the expressing cells using methods known to those skilled in the art. The purification process can be monitored using Western blot techniques, radioimmunoassay, or other standard immunoassay techniques. Polypeptide purification techniques are commonly known and used by those skilled in the art (see Scopes, 1982; Deutscher et al., 1990).

Embodiments of the presently disclosed subject matter provide a method for producing a recombinant polypeptide in which the expression vector comprise one or more elements including, but not limited to, a promoter-enhancer sequence, a selection marker sequence, an origin of replication, an epitope tag-encoding sequence, and an affinity purification tag-encoding sequence. In some embodiments, the nucleic acid construct comprises an epitope tag-encoding sequence and the isolating step employs an antibody specific for the epitope tag. In some embodiments, the nucleic acid construct comprises a polyamino acid-encoding sequence and the isolating step employs a resin comprising a polyamino acid binding substance, in some embodiments where the polyamino acid is polyhistidine and the polyamino acid binding resin is nickel-charged agarose resin. In some embodiments, the nucleic acid construct comprises a polypeptide-encoding sequence and the isolating step employs a resin comprising a polypeptide binding substance. In some embodiments, the polypeptide is a chitin-binding domain and the resin contains chitin-SEPHAROSE™.

The polypeptides of the presently disclosed subject matter can be synthesized using non-cellular synthetic methods known to those in the art. Techniques for solid phase synthesis are disclosed in Barany & Merrifield, 1980; Merrifield et al., 1963; Stewart & Young, 1984.

The presently disclosed subject matter further provides a method for modifying (i.e. increasing or decreasing) the concentration or composition of a polypeptide of the presently disclosed subject matter in a plant or part thereof. Modification can be effected by increasing or decreasing the concentration and/or the composition (i.e. the ration of the polypeptides of the presently disclosed subject matter) in a plant. The method comprises introducing into a plant cell an expression cassette comprising a nucleic acid molecule of the presently disclosed subject matter as disclosed above to obtain a transformed plant cell or tissue, and culturing the transformed plant cell or tissue. The nucleic acid molecule can be under the regulation of a constitutive or inducible promoter. The method can further comprise inducing or repressing expression of a nucleic acid molecule of a sequence in the plant for a time sufficient to modify the concentration and/or composition in the plant or plant part.

A plant or plant part having modified expression of a nucleic acid molecule of the presently disclosed subject matter can be analyzed and selected using methods known to those skilled in the art including, but not limited to, Southern blotting, DNA sequencing, or PCR analysis using primers specific to the nucleic acid molecule and detecting amplicons produced therefrom.

In general, a concentration or composition is increased or decreased by at least in some embodiments 5%, in some embodiments 10%, in some embodiments 20%, in some embodiments 30%, in some embodiments 40%, in some embodiments 50%, in some embodiments 60%, in some embodiments 70%, in some embodiments 80%, and in some embodiments 90% relative to a native control plant, plant part, or cell lacking the expression cassette.

B. Alteration of Expression of Nucleic Acid Molecules

The alteration in expression of the nucleic acid molecules of the presently disclosed subject matter can be achieved, for example, in one of the following ways:

1. "Sense" Suppression

Alteration of the expression of a nucleotide sequence of the presently disclosed subject matter, in some embodiments reduction of its expression, is obtained by "sense" suppression (referenced in, for example, Jorgensen et al., 1996). In this case, the entirety or a portion of a nucleotide sequence of the presently disclosed subject matter is comprised in a DNA molecule. The DNA molecule can be operatively linked to a promoter functional in a cell comprising the target gene, in some embodiments a plant cell, and introduced into the cell, in which the nucleotide sequence is expressible. The nucleotide sequence is inserted in the DNA molecule in the "sense orientation", meaning that the coding strand of the nucleotide sequence can be transcribed. In some embodiments, the nucleotide sequence is fully translatable and all the genetic information comprised in the nucleotide sequence, or portion thereof, is translated into a polypeptide. In some embodiments, the nucleotide sequence is partially translatable and a short peptide is translated. In some embodiments, this is achieved by inserting at least one premature stop codon in the nucleotide sequence, which brings translation to a halt. In some embodiments, the nucleotide sequence is transcribed but no translation product is made. This is usually achieved by removing the start codon, i.e. the "ATG", of the polypeptide encoded by the nucleotide sequence. In a further embodiment, the DNA molecule comprising the nucleotide sequence, or a portion thereof, is stably integrated in the genome of the plant cell. In some embodiments, the DNA molecule comprising the nucleotide sequence, or a portion thereof, is comprised in an extrachromosomally replicating molecule.

In transgenic plants containing one of the DNA molecules disclosed immediately above, the expression of the nucleotide sequence corresponding to the nucleotide sequence comprised in the DNA molecule can be reduced. The nucleotide sequence in the DNA molecule in some embodiments is at least 70% identical to the nucleotide sequence the expression of which is reduced, in some embodiments is at least 80% identical, in some embodiments is at least 90% identical, in some embodiments is at least 95% identical, and in some embodiments is at least 99% identical.

2. "Antisense" Suppression

In some embodiments, the alteration of the expression of a nucleotide sequence of the presently disclosed subject matter, for example the reduction of its expression, is obtained by "antisense" suppression. The entirety or a portion of a nucleotide sequence of the presently disclosed subject matter is comprised in a DNA molecule. The DNA molecule can be operatively linked to a promoter functional in a plant cell, and introduced in a plant cell, in which the nucleotide sequence is expressible. The nucleotide sequence is inserted in the DNA molecule in the "antisense orientation", meaning that the reverse complement (also called sometimes non-coding strand) of the nucleotide sequence can be transcribed. In some embodiments, the DNA molecule comprising the nucleotide sequence, or a portion thereof, is stably integrated in the genome of the plant cell. In some embodiments the DNA molecule comprising the nucleotide sequence, or a portion thereof, is comprised in an extrachromosomally replicating molecule. Several publications describing this approach are cited for further illustration (Green et al., 1986; van der Krol et al., 1991; Powell et al., 1989; Ecker & Davis, 1986).

In transgenic plants containing one of the DNA molecules disclosed immediately above, the expression of the nucleotide sequence corresponding to the nucleotide sequence comprised in the DNA molecule can be reduced. The nucleotide sequence in the DNA molecule is in some embodiments at least 70% identical to the nucleotide sequence the expression of which is reduced, in some embodiments at least 80% identical, in some embodiments at least 90% identical, in some embodiments at least 95% identical, and in some embodiments at least 99% identical.

3. Homologous Recombination

In some embodiments, at least one genomic copy corresponding to a nucleotide sequence of the presently disclosed subject matter is modified in the genome of the plant by homologous recombination as further illustrated in Paszkowski et al., 1988. This technique uses the ability of homologous sequences to recognize each other and to exchange nucleotide sequences between respective nucleic acid molecules by a process known in the art as homologous recombination. Homologous recombination can occur between the chromosomal copy of a nucleotide sequence in a cell and an incoming copy of the nucleotide sequence introduced in the cell by transformation. Specific modifications are thus accurately introduced in the chromosomal copy of the nucleotide sequence. In some embodiments, the regulatory elements of the nucleotide sequence of the presently disclosed subject matter are modified. Such regulatory elements are easily obtainable by screening a genomic library using the nucleotide sequence of the presently disclosed subject matter, or a portion thereof, as a probe. The existing regulatory elements are replaced by different regulatory elements, thus altering expression of the nucleotide sequence, or they are mutated or deleted, thus abolishing the expression of the nucleotide sequence. In some embodiments, the nucleotide sequence is modified by deletion of a part of the nucleotide sequence or the entire nucleotide sequence, or by mutation. Expression of a mutated polypeptide in a plant cell is also provided in the presently disclosed subject matter. Recent refinements of this technique to disrupt endogenous plant genes have been disclosed (Kempin et al., 1997 and Miao & Lam, 1995).

In some embodiments, a mutation in the chromosomal copy of a nucleotide sequence is introduced by transforming a cell with a chimeric oligonucleotide composed of a contiguous stretch of RNA and DNA residues in a duplex conformation with double hairpin caps on the ends. An additional feature of the oligonucleotide is for example the presence of 2'-O-methylation at the RNA residues. The RNA/DNA sequence is designed to align with the sequence of a chromosomal copy of a nucleotide sequence of the presently disclosed subject matter and to contain the desired nucleotide change. For example, this technique is further illustrated in U.S. Pat. No. 5,501,967 and Zhu et al., 1999.

4. Ribozymes

In a further embodiment, an RNA coding for a polypeptide of the presently disclosed subject matter is cleaved by a catalytic RNA, or ribozyme, specific for such RNA. The ribozyme is expressed in transgenic plants and results in reduced amounts of RNA coding for the polypeptide of the presently disclosed subject matter in plant cells, thus leading to reduced amounts of polypeptide accumulated in the cells. This method is further illustrated in U.S. Pat. No. 4,987,071.

5. Dominant-Negative Mutants

In some embodiments, the activity of a polypeptide encoded by the nucleotide sequences of the presently disclosed subject matter is changed. This is achieved by expression of dominant negative mutants of the polypeptides in transgenic plants, leading to the loss of activity of the endogenous polypeptide.

6. Aptamers

In a further embodiment, the activity of polypeptide of the presently disclosed subject matter is inhibited by expressing in transgenic plants nucleic acid ligands, so-called aptamers, which specifically bind to the polypeptide. Aptamers can be obtained by the SELEX (Systematic Evolution of Ligands by Exponential Enrichment) method. In the SELEX method, a candidate mixture of single stranded nucleic acids having regions of randomized sequence is contacted with the polypeptide and those nucleic acids having an increased affinity to the target are partitioned from the remainder of the candidate mixture. The partitioned nucleic acids are amplified to yield a ligand-enriched mixture. After several iterations a nucleic acid with optimal affinity to the polypeptide is obtained and is used for expression in transgenic plants. This method is further illustrated in U.S. Pat. No. 5,270,163.

7. Zinc Finger Polypeptides

A zinc finger polypeptide that binds a nucleotide sequence of the presently disclosed subject matter or to its regulatory region can also be used to alter expression of the nucleotide sequence. In alternative embodiments, transcription of the nucleotide sequence is reduced or increased. Zinc finger polypeptides are disclosed in, for example, Beerli et al., 1998, or in WO 95/19431, WO 98/54311, or WO 96/06166, all incorporated herein by reference in their entirety.

8. dsRNA

Alteration of the expression of a nucleotide sequence of the presently disclosed subject matter can also be obtained by double stranded RNA (dsRNA) interference (RNAi) as disclosed, for example, in WO 99/32619, WO 99/53050, or WO 99/61631, all incorporated herein by reference in their entireties. In some embodiments, the alteration of the expression of a nucleotide sequence of the presently disclosed subject matter, in some embodiments the reduction of its expression, is obtained by dsRNA interference. The entirety, or in some embodiments a portion, of a nucleotide sequence of the presently disclosed subject matter, can be comprised in a DNA molecule. The size of the DNA molecule is in some embodiments from 100 to 1000 nucleotides or more; the optimal size to be determined empirically. Two copies of the identical DNA molecule are linked, separated by a spacer DNA molecule, such that the first and second copies are in opposite orientations. In some embodiments, the first copy of the DNA molecule is the reverse complement (also known as the non-coding strand) and the second copy is the coding strand; in some embodiments, the first copy is the coding strand, and the second copy is the reverse complement. The size of the spacer DNA molecule is in some embodiments 200 to 10,000 nucleotides, in some embodiments 400 to 5000 nucleotides, and in some embodiments 600 to 1500 nucleotides in length. The spacer is in some embodiments a random piece of DNA, in some embodiments a random piece of DNA without homology to the target organism for dsRNA interference, and in some embodiments a functional intron that is effectively spliced by the target organism. The two copies of the DNA molecule separated by the spacer are operatively linked to a promoter functional in a plant cell, and introduced in a plant cell in which the nucleotide sequence is expressible. In some embodiments, the DNA molecule comprising the nucleotide sequence, or a portion thereof, is stably integrated in the genome of the plant cell. In some embodiments, the DNA molecule comprising the nucleotide sequence, or a portion thereof, is comprised in an extrachromosomally replicating molecule. Several publications describing this approach are cited for further illustration (Waterhouse et al., 1998; Chuang & Meyerowitz, 2000; Smith et al., 2000).

In transgenic plants containing one of the DNA molecules disclosed immediately above, the expression of the nucleotide sequence corresponding to the nucleotide sequence comprised in the DNA molecule is in some embodiments reduced. In some embodiments, the nucleotide sequence in the DNA molecule is at least 70% identical to the nucleotide sequence the expression of which is reduced, in some embodiments it is at least 80% identical, in some embodiments it is at least 90% identical, in some embodiments it is at least 95% identical, and in some embodiments it is at least 99% identical.

9. Insertion of a DNA Molecule (Insertional Mutagenesis)

In some embodiments, a DNA molecule is inserted into a chromosomal copy of a nucleotide sequence of the presently disclosed subject matter, or into a regulatory region thereof. In some embodiments, such DNA molecule comprises a transposable element capable of transposition in a plant cell, such as, for example, Ac/Ds, Em/Spm, mutator. Alternatively, the DNA molecule comprises a T-DNA border of an *Agrobacterium* T-DNA. The DNA molecule can also comprise a recombinase or integrase recognition site that can be used to remove part of the DNA molecule from the chromosome of the plant cell. Methods of insertional mutagenesis using T-DNA, transposons, oligonucleotides, or other methods known to those skilled in the art are also encompassed. Methods of using T-DNA and transposon for insertional mutagenesis are disclosed in Winkler & Feldmann, 1989, and Martienssen, 1998, incorporated herein by reference in their entireties.

10. Deletion Mutagenesis

In some embodiments, a mutation of a nucleic acid molecule of the presently disclosed subject matter is created in the genomic copy of the sequence in the cell or plant by deletion of a portion of the nucleotide sequence or regulator sequence. Methods of deletion mutagenesis are known to those skilled in the art. See e.g., Miao & Lam, 1995.

In some embodiments, a deletion is created at random in a large population of plants by chemical mutagenesis or irradiation and a plant with a deletion in a gene of the presently disclosed subject matter is isolated by forward or reverse genetics. Irradiation with fast neutrons or gamma rays is known to cause deletion mutations in plants (Silverstone et al., 1998; Bruggemann et al., 1996; Redei & Koncz, 1992). Deletion mutations in a gene of the presently disclosed subject matter can be recovered in a reverse genetics strategy using PCR with pooled sets of genomic DNAs as has been shown in *C. elegans* (Liu et al., 1999). A forward genetics strategy involves mutagenesis of a line bearing a trait of interest followed by screening the M2 progeny for the absence of the trait. Among these mutants would be expected to be some that disrupt a gene of the presently disclosed subject matter. This could be assessed by Southern blotting or PCR using primers designed for a gene of the presently disclosed subject matter with genomic DNA from these mutants.

11. Overexpression in a Plant Cell

In some embodiments, a nucleotide sequence of the presently disclosed subject matter encoding a polypeptide is over-expressed. Examples of nucleic acid molecules and expression cassettes for over-expression of a nucleic acid molecule of the presently disclosed subject matter are disclosed above. Methods known to those skilled in the art of over-expression of nucleic acid molecules are also encompassed by the presently disclosed subject matter.

In some embodiments, the expression of the nucleotide sequence of the presently disclosed subject matter is altered in every cell of a plant. This can be obtained, for example, though homologous recombination or by insertion into a chromosome. This can also be obtained, for example, by expressing a sense or antisense RNA, zinc finger polypeptide or ribozyme under the control of a promoter capable of expressing the sense or antisense RNA, zinc finger polypeptide, or ribozyme in every cell of a plant. Constitutive, inducible, tissue-specific, or developmentally-regulated expression are also within the scope of the presently disclosed subject matter and result in a constitutive, inducible, tissue-specific, or developmentally-regulated alteration of the expression of a nucleotide sequence of the presently disclosed subject matter in the plant cell. Constructs for expression of the sense or antisense RNA, zinc finger polypeptide, or ribozyme, or for over-expression of a nucleotide sequence of the presently disclosed subject matter, can be prepared and transformed into a plant cell according to the teachings of the presently disclosed subject matter, for example, as disclosed herein.

C. Construction of Plant Expression Vectors

Coding sequences intended for expression in transgenic plants can be first assembled in expression cassettes operatively linked to a suitable promoter expressible in plants. The expression cassettes can also comprise any further sequences required or selected for the expression of the transgene. Such sequences include, but are not limited to, transcription terminators, extraneous sequences to enhance expression such as introns, vital sequences, and sequences intended for the targeting of the gene product to specific organelles and cell compartments. These expression cassettes can then be easily transferred to the plant transformation vectors disclosed below. The following is a description of various components of typical expression cassettes.

1. Promoters

The selection of the promoter used in expression cassettes can determine the spatial and temporal expression pattern of the transgene in the transgenic plant. Selected promoters can express transgenes in specific cell types (such as leaf epidermal cells, mesophyll cells, root cortex cells) or in specific tissues or organs (roots, leaves, or flowers, for example) and the selection can reflect the desired location for accumulation of the gene product. Alternatively, the selected promoter can drive expression of the gene under various inducing conditions. Promoters vary in their strength; i.e., their abilities to promote transcription. Depending upon the host cell system utilized, any one of a number of suitable promoters can be used, including the gene's native promoter. The following are non-limiting examples of promoters that can be used in expression cassettes.

a. Constitutive Expression: the Ubiquitin Promoter

Ubiquitin is a gene product known to accumulate in many cell types and its promoter has been cloned from several species for use in transgenic plants (e.g. sunflower—Binet et al., 1991; maize—Christensen et al., 1989; and *Arabidopsis*—Callis et al., 1990; Norris et al., 1993). The maize ubiquitin promoter has been developed in transgenic monocot systems and its sequence and vectors constructed for monocot transformation are disclosed in the patent publication EP 0 342 926 (to Lubrizol) which is herein incorporated by reference. Taylor et al., 1993, describes a vector (pAHC25) that comprises the maize ubiquitin promoter and first intron and its high activity in cell suspensions of numerous monocotyledons when introduced via microprojectile bombardment. The *Arabidopsis* ubiquitin promoter is suitable for use with the nucleotide sequences of the presently disclosed subject matter. The ubiquitin promoter is suitable for gene expression in transgenic plants, both monocotyledons and dicotyledons. Suitable vectors are derivatives of pAHC25 or any of the transformation vectors disclosed herein, modified by the introduction of the appropriate ubiquitin promoter and/or intron sequences.

b. Constitutive Expression: the CaMV 35S Promoter

Construction of the plasmid pCGN1761 is disclosed in the published patent application EP 0 392 225 (Example 23), which is hereby incorporated by reference. pCGN1761 contains the "double" CaMV 35S promoter and the tml transcriptional terminator with a unique EcoRI site between the promoter and the terminator and has a pUC-type backbone. A derivative of pCGN1761 is constructed which has a modified polylinker that includes NotI and XhoI sites in addition to the existing EcoRI site. This derivative is designated pCGN1761ENX. pCGN1761ENX is useful for the cloning of cDNA sequences or coding sequences (including microbial ORF sequences) within its polylinker for the purpose of their expression under the control of the 35S promoter in transgenic plants. The entire 35S promoter-coding sequence-tml terminator cassette of such a construction can be excised by HindIII, SphI, SalI, and XbaI sites 5' to the promoter and XbaI, BamHI and BglI sites 3' to the terminator for transfer to transformation vectors such as those disclosed below. Furthermore, the double 35S promoter fragment can be removed by 5' excision with HindIII, SphI, SalI, XbaI, or PstI, and 3' excision with any of the polylinker restriction sites (EcoRI, NotI or XhoI) for replacement with another promoter. If desired, modifications around the cloning sites can be made by the introduction of sequences that can enhance translation. This is particularly useful when overexpression is desired. For example, pCGN1761ENX can be modified by optimization of the translational initiation site as disclosed in Example 37 of U.S. Pat. No. 5,639,949, incorporated herein by reference.

c. Constitutive Expression: the Actin Promoter

Several isoforms of actin are known to be expressed in most cell types and consequently the actin promoter can be used as a constitutive promoter. In particular, the promoter from the rice ActI gene has been cloned and characterized (McElroy et al., 1990). A 1.3 kilobase (kb) fragment of the promoter was found to contain all the regulatory elements required for expression in rice protoplasts. Furthermore, numerous expression vectors based on the ActI promoter have been constructed specifically for use in monocotyledons (McElroy et al., 1991). These incorporate the ActI-intron 1, AdhI 5' flanking sequence (from the maize alcohol dehydrogenase gene) and AdhI-intron 1 and sequence from the CaMV 35S promoter. Vectors showing highest expression were fusions of 35S and ActI intron or the ActI 5' flanking sequence and the ActI intron. Optimization of sequences around the initiating ATG (of the β-glucuronidase (GUS) reporter gene) also enhanced expression. The promoter expression cassettes disclosed in McElroy et al., 1991, can be easily modified for gene expression and are particularly suitable for use in monocotyledonous hosts. For example, promoter-containing fragments are removed from the McElroy constructions and used to replace the double 35S promoter in pCGN1761ENX, which is then available for the insertion of specific gene sequences. The fusion genes thus constructed can then be transferred to appropriate transformation vectors. In a separate report, the rice ActI promoter with its first intron has also been found to direct high expression in cultured barley cells (Chibbar et al., 1993).

d. Inducible Expression: PR-1 Promoters

The double 35S promoter in pCGN1761ENX can be replaced with any other promoter of choice that will result in suitably high expression levels. By way of example, one of the chemically regulatable promoters disclosed in U.S. Pat. No. 5,614,395, such as the tobacco PR-1a promoter, can replace the double 35S promoter. Alternately, the *Arabidopsis* PR-1 promoter disclosed in Lebel et al., 1998, can be used. The promoter of choice can be excised from its source by restriction enzymes, but can alternatively be PCR-amplified using primers that carry appropriate terminal restriction sites. Should PCR-amplification be undertaken, the promoter can be re-sequenced to check for amplification errors after the cloning of the amplified promoter in the target vector. The chemically/pathogen regulatable tobacco PR-1a promoter is cleaved from plasmid pCIB1004 (for construction, see example 21 of EP 0 332 104, which is hereby incorporated by reference) and transferred to plasmid pCGN1761ENX (Uknes et al., 1992). pCIB1004 is cleaved with NcoI and the resulting 3' overhang of the linearized fragment is rendered blunt by treatment with T4 DNA polymerase. The fragment is then cleaved with HindIII and the resultant PR-1a promoter-containing fragment is gel purified and cloned into pCGN1761ENX from which the double 35S promoter has been removed. This is accomplished by cleavage with XhoI and blunting with T4 polymerase, followed by cleavage with HindIII, and isolation of the larger vector-terminator containing fragment into which the pCIB1004 promoter fragment is cloned. This generates a pCGN1761ENX derivative with the PR-1a promoter and the tml terminator and an intervening polylinker with unique EcoRI and NotI sites. The selected coding sequence can be inserted into this vector, and the fusion products (i.e. promoter-gene-terminator) can subsequently be transferred to any selected transformation vector, including those disclosed herein. Various chemical regulators can be employed to induce expression of the selected coding sequence in the plants transformed according to the presently disclosed subject matter, including the benzothiadiazole, isonicotinic acid, and salicylic acid compounds disclosed in U.S. Pat. Nos. 5,523,311 and 5,614,395.

e. Inducible Expression: an Ethanol-Inducible Promoter

A promoter inducible by certain alcohols or ketones, such as ethanol, can also be used to confer inducible expression of a coding sequence of the presently disclosed subject matter. Such a promoter is for example the alcA gene promoter from *Aspergillus nidulans* (Caddick et al., 1998). In *A. nidulans*, the alcA gene encodes alcohol dehydrogenase I, the expression of which is regulated by the AlcR transcription factors in presence of the chemical inducer. For the purposes of the presently disclosed subject matter, the CAT coding sequences in plasmid palcA:CAT comprising a alcA gene promoter sequence fused to a minimal 35S promoter (Caddick et al., 1998) are replaced by a coding sequence of the presently disclosed subject matter to form an expression cassette having the coding sequence under the control of the alcA gene promoter. This is carried out using methods known in the art.

f. Inducible Expression: a Glucocorticoid-Inducible Promoter

Induction of expression of a nucleic acid sequence of the presently disclosed subject matter using systems based on steroid hormones is also provided. For example, a glucocorticoid-mediated induction system is used (Aoyama & Chua, 1997) and gene expression is induced by application of a glucocorticoid, for example a synthetic glucocorticoid, for example dexamethasone, at a concentration ranging in some embodiments from 0.1 mM to 1 mM, and in some embodiments from 10 mM to 100 mM. For the purposes of the presently disclosed subject matter, the luciferase gene sequences Aoyama & Chua are replaced by a nucleic acid sequence of the presently disclosed subject matter to form an expression cassette having a nucleic acid sequence of the presently disclosed subject matter under the control of six copies of the GAL4 upstream activating sequences fused to the 35S minimal promoter. This is carried out using methods known in the art. The trans-acting factor comprises the GAL4 DNA-binding domain (Keegan et al., 1986) fused to the transactivating domain of the herpes viral polypeptide VP16 (Triezenberg et al., 1988) fused to the hormone-binding domain of the rat glucocorticoid receptor (Picard et al., 1988). The expression of the fusion polypeptide is controlled either by a promoter known in the art or disclosed herein. A plant comprising an expression cassette comprising a nucleic acid sequence of the presently disclosed subject matter fused to the 6×GAL4/minimal promoter is also provided. Thus, tissue- or organ-specificity of the fusion polypeptide is achieved leading to inducible tissue- or organ-specificity of the nucleic acid sequence to be expressed.

g. Root Specific Expression

Another pattern of gene expression is root expression. A suitable root promoter is the promoter of the maize metallothionein-like (MTL) gene disclosed in de Framond, 1991, and also in U.S. Pat. No. 5,466,785, each of which is incorporated herein by reference. This "MTL" promoter is transferred to a suitable vector such as pCGN1761ENX for the insertion of a selected gene and subsequent transfer of the entire promoter-gene-terminator cassette to a transformation vector of interest.

h. Wound-Inducible Promoters

Wound-inducible promoters can also be suitable for gene expression. Numerous such promoters have been disclosed (e.g. Xu et al., 1993; Logemann et al., 1989; Rohrmeier & Lehle, 1993; Firek et al., 1993; Warner et al., 1993) and all are suitable for use with the presently disclosed subject matter. Logemann et al. describe the 5' upstream sequences of the dicotyledonous potato wunI gene. Xu et al. show that a wound-inducible promoter from the dicotyledon potato (pin2) is active in the monocotyledon rice. Further, Rohrmeier & Lehle describe the cloning of the maize WipI cDNA that is wound induced and which can be used to isolate the cognate promoter using standard techniques. Similarly, Firek et al. and Warner et al. have disclosed a wound-induced gene from the monocotyledon *Asparagus officinalis*, which is expressed at local wound and pathogen invasion sites. Using cloning techniques well known in the art, these promoters can be transferred to suitable vectors, fused to the genes pertaining to the presently disclosed subject matter, and used to express these genes at the sites of plant wounding.

i. Pith-Preferred Expression

PCT International Publication WO 93/07278, which is herein incorporated by reference, describes the isolation of the maize trpA gene, which is preferentially expressed in pith cells. The gene sequence and promoter extending up to −1726 basepairs (bp) from the start of transcription are presented. Using standard molecular biological techniques, this promoter, or parts thereof, can be transferred to a vector such as pCGN1761 where it can replace the 35S promoter and be used to drive the expression of a foreign gene in a pith-preferred manner. In fact, fragments containing the pith-preferred promoter or parts thereof can be transferred to any vector and modified for utility in transgenic plants.

j. Leaf-Specific Expression

A maize gene encoding phosphoenol carboxylase (PEPC) has been disclosed by Hudspeth & Grula, 1989. Using standard molecular biological techniques, the promoter for this gene can be used to drive the expression of any gene in a leaf-specific manner in transgenic plants.

k. Pollen-Specific Expression

WO 93/07278 describes the isolation of the maize calcium-dependent protein kinase (CDPK) gene that is expressed in pollen cells. The gene sequence and promoter extend up to 1400 bp from the start of transcription. Using standard molecular biological techniques, this promoter, or parts thereof can be transferred to a vector such as pCGN1761 where it can replace the 35S promoter and be used to drive the expression of a nucleic acid sequence of the presently disclosed subject matter in a pollen-specific manner.

2. Transcriptional Terminators

A variety of transcriptional terminators are available for use in expression cassettes. These are responsible for termination of transcription and correct mRNA polyadenylation. Appropriate transcriptional terminators are those that are known to function in plants and include the CaMV 35S terminator, the tml terminator, the nopaline synthase terminator, and the pea rbcS E9 terminator. These can be used in both monocotyledons and dicotyledons. In addition, a gene's native transcription terminator can be used.

3. Sequences for the Enhancement or Regulation of Expression

Numerous sequences have been found to enhance gene expression from within the transcriptional unit and these sequences can be used in conjunction with the genes of the presently disclosed subject matter to increase their expression in transgenic plants.

Various intron sequences have been shown to enhance expression, particularly in monocotyledonous cells. For example, the introns of the maize AdhI gene have been found to significantly enhance the expression of the wild-type gene under its cognate promoter when introduced into maize cells. Intron 1 was found to be particularly effective and enhanced expression in fusion constructs with the chloramphenicol acetyltransferase gene (Callis et al., 1987). In the same experimental system, the intron from the maize bronze1 gene had a similar effect in enhancing expression. Intron sequences have been routinely incorporated into plant transformation vectors, typically within the non-translated leader.

A number of non-translated leader sequences derived from viruses are also known to enhance expression, and these are particularly effective in dicotyledonous cells. Specifically, leader sequences from Tobacco Mosaic Virus (TMV; the "W-sequence"), Maize Chlorotic Mottle Virus (MCMV), and Alfalfa Mosaic Virus (AMV) have been shown to be effective in enhancing expression (see e.g. Gallie et al., 1987; Skuzeski et al., 1990). Other leader sequences known in the art include, but are not limited to, picornavirus leaders, for example, EMCV (encephalomyocarditis virus) leader (5' noncoding region; see Elroy-Stein et al., 1989); potyvirus leaders, for example, from Tobacco Etch Virus (TEV; see Allison et al., 1986); Maize Dwarf Mosaic Virus (MDMV; see Kong & Steinbiss 1998); human immunoglobulin heavy-chain binding polypeptide (BiP) leader (Macejak & Sarnow, 1991); untranslated leader from the coat polypeptide mRNA of alfalfa mosaic virus (AMV; RNA 4; see Jobling & Gehrke, 1987); tobacco mosaic virus (TMV) leader (Gallie et al., 1989); and Maize Chlorotic Mottle Virus (MCMV) leader (Lommel et al., 1991). See also, Della-Cioppa et al., 1987.

In addition to incorporating one or more of the aforementioned elements into the 5' regulatory region of a target expression cassette of the presently disclosed subject matter, other elements can also be incorporated. Such elements include, but are not limited to, a minimal promoter. By minimal promoter it is intended that the basal promoter elements are inactive or nearly so in the absence of upstream or downstream activation. Such a promoter has low background activity in plants when there is no transactivator present or when enhancer or response element binding sites are absent. One minimal promoter that is particularly useful for target genes in plants is the Bz1 minimal promoter, which is obtained from the bronze1 gene of maize. The Bz1 core promoter is obtained from the "myc" mutant Bz1-luciferase construct pBz1LucR98 via cleavage at the NheI site located at positions −53 to −58 (Roth et al., 1991). The derived Bz1 core promoter fragment thus extends from positions −53 to +227 and includes the Bz1 intron-1 in the 5' untranslated region. Also useful for the presently disclosed subject matter is a minimal promoter created by use of a synthetic TATA element. The TATA element allows recognition of the promoter by RNA polymerase factors and confers a basal level of gene expression in the absence of activation (see generally, Mukumoto et al., 1993; Green, 2000.

4. Targeting of the Gene Product within the Cell

Various mechanisms for targeting gene products are known to exist in plants and the sequences controlling the functioning of these mechanisms have been characterized in some detail. For example, the targeting of gene products to the chloroplast is controlled by a signal sequence found at the amino terminal end of various polypeptides that is cleaved during chloroplast import to yield the mature polypeptides (see e.g., Comai et al., 1988). These signal sequences can be fused to heterologous gene products to affect the import of heterologous products into the chloroplast (Van den Broeck et al., 1985). DNA encoding for appropriate signal sequences can be isolated from the 5' end of the cDNAs encoding the ribulose-1,5-bisphosphate carboxylase/oxygenase (RUBISCO) polypeptide, the chlorophyll a/b binding (CAB) polypeptide, the 5-enol-pyruvyl shikimate-3-phosphate (EPSP) synthase enzyme, the GS2 polypeptide and many other polypeptides which are known to be chloroplast localized. See also, the section entitled "Expression With Chloroplast Targeting" in Example 37 of U.S. Pat. No. 5,639,949, herein incorporated by reference.

Other gene products can be localized to other organelles such as the mitochondrion and the peroxisome (e.g. Unger et al., 1989). The cDNAs encoding these products can also be manipulated to effect the targeting of heterologous gene products to these organelles. Examples of such sequences are the nuclear-encoded ATPases and specific aspartate amino transferase isoforms for mitochondria. Targeting cellular polypeptide bodies has been disclosed by Rogers et al., 1985.

In addition, sequences have been characterized that control the targeting of gene products to other cell compartments. Amino terminal sequences are responsible for targeting to the endoplasmic reticulum (ER), the apoplast, and extracellular secretion from aleurone cells (Koehler & Ho, 1990). Additionally, amino terminal sequences in conjunction with carboxy terminal sequences are responsible for vacuolar targeting of gene products (Shinshi et al., 1990).

By the fusion of the appropriate targeting sequences disclosed above to transgene sequences of interest it is possible to direct the transgene product to any organelle or cell compartment. For chloroplast targeting, for example, the chloroplast signal sequence from the RUBISCO gene, the CAB gene, the EPSP synthase gene, or the GS2 gene is fused in frame to the amino terminal ATG of the transgene. The signal sequence selected can include the known cleavage site, and the fusion constructed can take into account any amino acids after the cleavage site that are required for cleavage. In some cases this requirement can be fulfilled by the addition of a small number of amino acids between the cleavage site and the transgene ATG or, alternatively, replacement of some amino acids within the transgene sequence. Fusions constructed for chloroplast import can be tested for efficacy of chloroplast uptake by in vitro translation of in vitro transcribed constructions followed by in vitro chloroplast uptake using techniques disclosed by Bartlett et al., 1982 and Wasmann et al., 1986. These construction techniques are well known in the art and are equally applicable to mitochondria and peroxisomes.

The above-disclosed mechanisms for cellular targeting can be utilized not only in conjunction with their cognate promoters, but also in conjunction with heterologous promoters so as to effect a specific cell-targeting goal under the transcriptional regulation of a promoter that has an expression pattern different from that of the promoter from which the targeting signal derives.

D. Construction of Plant Transformation Vectors

Numerous transformation vectors available for plant transformation are known to those of ordinary skill in the plant transformation art, and the genes pertinent to the presently disclosed subject matter can be used in conjunction with any such vectors. The selection of vector will depend upon the selected transformation technique and the target species for transformation. For certain target species, different antibiotic or herbicide selection markers might be employed. Selection markers used routinely in transformation include the nptII gene, which confers resistance to kanamycin and related antibiotics (Messing & Vieira, 1982; Bevan et al., 1983); the bar gene, which confers resistance to the herbicide phosphinothricin (White et al., 1990; Spencer et al., 1990); the hph gene, which confers resistance to the antibiotic hygromycin (Blochinger & Diggelmann, 1984); the dhfr gene, which confers resistance to methotrexate (Bourouis & Jarry, 1983); the EPSP synthase gene, which confers resistance to glyphosate (U.S. Pat. Nos. 4,940,935 and 5,188,642); and the mannose-6-phosphate isomerase gene, which provides the ability to metabolize mannose (U.S. Pat. Nos. 5,767,378 and 5,994,629).

1. Vectors Suitable for *Agrobacterium* Transformation

Many vectors are available for transformation using *Agrobacterium tumefaciens*. These typically carry at least one T-DNA border sequence and include vectors such as pBIN19 (Bevan, 1984). Below, the construction of two typical vectors suitable for *Agrobacterium* transformation is disclosed.

a. pCIB200 and pCIB2001

The binary vectors pCIB200 and pCIB2001 are used for the construction of recombinant vectors for use with *Agrobacterium* and are constructed in the following manner. pTJS75kan is created by NarI digestion of pTJS75 (Schmidhauser & Helinski, 1985) allowing excision of the tetracycline-resistance gene, followed by insertion of an AccI fragment from pUC4K carrying an NPTII sequence (Messing & Vieira, 1982: Bevan et al., 1983: McBride & Summerfelt. 1990). XhoI linkers are ligated to the EcoRV fragment of PCIB7 which contains the left and right T-DNA borders, a plant selectable nos/nptII chimeric gene and the pUC polylinker (Rothstein et al., 1987), and the XhoI-digested fragment are cloned into SalI-digested pTJS75kan to create pCIB200 (see also EP 0 332 104, example 19). pCIB200 contains the following unique polylinker restriction sites: EcoRI, SstI, KpnI, BglII, XbaI, and SalI. pCIB2001 is a derivative of pCIB200 created by the insertion into the polylinker of additional restriction sites. Unique restriction sites in the polylinker of pCIB2001 are EcoRI, SstI, KpnI, BglII, XbaI, SalI, MluI, BclI, AvrII, ApaI, HpaI, and StuI. pCIB2001, in addition to containing these unique restriction sites, also has plant and bacterial kanamycin selection, left and right T-DNA borders for *Agrobacterium*-mediated transformation, the RK2-derived trfA function for mobilization between *E. coli* and other hosts, and the OriT and OriV functions also from RK2. The pCIB2001 polylinker is suitable for the cloning of plant expression cassettes containing their own regulatory signals.

b. pCIB10 and Hygromycin Selection Derivatives thereof

The binary vector pCIB10 contains a gene encoding kanamycin resistance for selection in plants, T-DNA right and left border sequences, and incorporates sequences from the wide host-range plasmid pRK252 allowing it to replicate in both *E. coli* and *Agrobacterium*. Its construction is disclosed by Rothstein et al., 1987. Various derivatives of pCIB10 can be constructed which incorporate the gene for hygromycin B phosphotransferase disclosed by Gritz & Davies, 1983. These derivatives enable selection of transgenic plant cells on hygromycin only (pCIB743), or hygromycin and kanamycin (pCIB715, pCIB717).

2. Vectors Suitable for non-*Agrobacterium* Transformation

Transformation without the use of *Agrobacterium tumefaciens* circumvents the requirement for T-DNA sequences in the chosen transformation vector, and consequently vectors lacking these sequences can be utilized in addition to vectors such as the ones disclosed above that contain T-DNA sequences. Transformation techniques that do not rely on *Agrobacterium* include transformation via particle bombardment, protoplast uptake (e.g. polyethylene glycol (PEG) and electroporation), and microinjection. The choice of vector depends largely on the species being transformed. Below, the construction of typical vectors suitable for non-*Agrobacterium* transformation is disclosed.

a. pCIB3064 pCIB3064 is a pUC-derived vector suitable for direct gene transfer techniques in combination with selection by the herbicide BASTA® (glufosinate ammonium or phosphinothricin). The plasmid pCIB246 comprises the CaMV 35S promoter in operational fusion to the *E. coli* β-glucuronidase (GUS) gene and the CaMV 35S transcriptional terminator and is disclosed in the PCT International Publication WO 93/07278. The 35S promoter of this vector contains two ATG sequences 5' of the start site. These sites are mutated using standard PCR techniques in such a way as to remove the ATGs and generate the restriction sites SspI and PvuII. The new restriction sites are 96 and 37 bp away from the unique SalI site and 101 and 42 bp away from the actual start site. The resultant derivative of pCIB246 is designated pCIB3025. The GUS gene is then excised from pCIB3025 by digestion with SalI and SacI, the termini rendered blunt and religated to generate plasmid pCIB3060. The plasmid pJIT82 is obtained from the John Innes Centre, Norwich, England, and the 400 bp SmaI fragment containing the bar gene from *Streptomyces viridochromogenes* is excised and inserted into the HpaI site of pCIB3060 (Thompson et al., 1987). This generated pCIB3064, which comprises the bar gene under the control of the CaMV 35S promoter and terminator for herbicide selection, a gene for ampicillin resistance (for selection in *E. coli*) and a polylinker with the unique sites SphI, PstI, HindIII, and BamHI. This vector is suitable for the cloning of plant expression cassettes containing their own regulatory signals.

b. pSOG19 and pSOG35 pSOG35 is a transformation vector that utilizes the *E. coli* dihydrofolate reductase (DHFR) gene as a selectable marker conferring resistance to methotrexate. PCR is used to amplify the 35S promoter (~800 bp), intron 6 from the maize AdhI gene (~550 bp), and 18 bp of the GUS untranslated leader sequence from pSOG10. A 250-bp fragment encoding the *E. coli* dihydrofolate reductase type II gene is also amplified by PCR and these two PCR fragments are assembled with a SacI-PstI fragment from pB1221 (BD Biosciences Clontech, Palo Alto, Calif., United States of America) that comprises the pUC19 vector backbone and the nopaline synthase terminator. Assembly of these fragments generates pSOG19 that contains the 35S promoter in fusion with the intron 6 sequence, the GUS leader, the DHFR gene, and the nopaline synthase terminator. Replacement of the GUS leader in pSOG19 with the leader sequence from Maize Chlorotic Mottle Virus (MCMV) generates the vector pSOG35. pSOG19 and pSOG35 carry the pUC gene for ampicillin resistance and have HindIII, SphI, PstI, and EcoRI sites available for the cloning of foreign substances.

3. Vector Suitable for Chloroplast Transformation

For expression of a nucleotide sequence of the presently disclosed subject matter in plant plastids, plastid transformation vector pPH143 (PCT International Publication WO 97/32011, example 36) is used. The nucleotide sequence is inserted into pPH143 thereby replacing the protoporphyrinogen oxidase (Protox) coding sequence. This vector is then used for plastid transformation and selection of transformants for spectinomycin resistance. Alternatively, the nucleotide sequence is inserted in pPH143 so that it replaces the aadH gene. In this case, transformants are selected for resistance to PROTOX inhibitors.

E. Transformation

Once a nucleic acid sequence of the presently disclosed subject matter has been cloned into an expression system, it is transformed into a plant cell. The receptor and target expression cassettes of the presently disclosed subject matter can be introduced into the plant cell in a number of art-recognized ways. Methods for regeneration of plants are also well known in the art. For example, Ti plasmid vectors have been utilized for the delivery of foreign DNA, as well as direct DNA uptake, liposomes, electroporation, microinjection, and microprojectiles. In addition, bacteria from the genus *Agrobacterium* can be utilized to transform plant cells. Below are descriptions of representative techniques for transforming both dicotyledonous and monocotyledonous plants, as well as a representative plastid transformation technique.

1. Transformation of Dicotyledons

Transformation techniques for dicotyledons are well known in the art and include *Agrobacterium*-based techniques and techniques that do not require *Agrobacterium*. Non-*Agrobacterium* techniques involve the uptake of exogenous genetic material directly by protoplasts or cells. This can be accomplished by PEG or electroporation-mediated uptake, particle bombardment-mediated delivery, or microinjection. Examples of these techniques are disclosed in Paszkowski et al., 1984; Potrykus et al., 1985; Reich et al., 1986;

and Klein et al., 1987. In each case the transformed cells are regenerated to whole plants using standard techniques known in the art.

*Agrobacterium*-mediated transformation is a useful technique for transformation of dicotyledons because of its high efficiency of transformation and its broad utility with many different species. *Agrobacterium* transformation typically involves the transfer of the binary vector carrying the foreign DNA of interest (e.g. pCIB200 or pCIB2001) to an appropriate *Agrobacterium* strain which can depend on the complement of vir genes carried by the host *Agrobacterium* strain either on a co-resident Ti plasmid or chromosomally (e.g. strain CIB542 for pCIB200 and pCIB2001 (Uknes et al., 1993). The transfer of the recombinant binary vector to *Agrobacterium* is accomplished by a triparental mating procedure using *E. coli* carrying the recombinant binary vector, a helper *E. coli* strain that carries a plasmid such as pRK2013 and which is able to mobilize the recombinant binary vector to the target *Agrobacterium* strain. Alternatively, the recombinant binary vector can be transferred to *Agrobacterium* by DNA transformation (Höfgen & Willmitzer, 1988).

Transformation of the target plant species by recombinant *Agrobacterium* usually involves co-cultivation of the *Agrobacterium* with explants from the plant and follows protocols well known in the art. Transformed tissue is regenerated on selectable medium carrying the antibiotic or herbicide resistance marker present between the binary plasmid T-DNA borders.

Another approach to transforming plant cells with a gene involves propelling inert or biologically active particles at plant tissues and cells. This technique is disclosed in U.S. Pat. Nos. 4,945,050; 5,036,006; and 5,100,792; all to Sanford et al. Generally, this procedure involves propelling inert or biologically active particles at the cells under conditions effective to penetrate the outer surface of the cell and afford incorporation within the interior thereof. When inert particles are utilized, the vector can be introduced into the cell by coating the particles with the vector containing the desired gene. Alternatively, the target cell can be surrounded by the vector so that the vector is carried into the cell by the wake of the particle. Biologically active particles (e.g., dried yeast cells, dried bacterium, or a bacteriophage, each containing DNA sought to be introduced) can also be propelled into plant cell tissue.

2. Transformation of Monocotyledons

Transformation of most monocotyledon species has now also become routine. Exemplary techniques include direct gene transfer into protoplasts using PEG or electroporation, and particle bombardment into callus tissue. Transformations can be undertaken with a single DNA species or multiple DNA species (i.e. co-transformation), and both these techniques are suitable for use with the presently disclosed subject matter. Co-transformation can have the advantage of avoiding complete vector construction and of generating transgenic plants with unlinked loci for the gene of interest and the selectable marker, enabling the removal of the selectable marker in subsequent generations, should this be regarded as desirable. However, a disadvantage of the use of co-transformation is the less than 100% frequency with which separate DNA species are integrated into the genome (Schocher et al., 1986).

Patent Applications EP 0 292 435, EP 0 392 225, and WO 93/07278 describe techniques for the preparation of callus and protoplasts from an elite inbred line of maize, transformation of protoplasts using PEG or electroporation, and the regeneration of maize plants from transformed protoplasts. Gordon-Kamm et al., 1990 and Fromm et al., 1990 have published techniques for transformation of A188-derived maize line using particle bombardment. Furthermore, WO 93/07278 and Koziel et al., 1993 describe techniques for the transformation of elite inbred lines of maize by particle bombardment. This technique utilizes immature maize embryos of 1.5-2.5 mm length excised from a maize ear 14-15 days after pollination and a PDS-1000He Biolistic particle delivery device (DuPont Biotechnology, Wilmington, Del., United States of America) for bombardment.

Transformation of rice can also be undertaken by direct gene transfer techniques utilizing protoplasts or particle bombardment. Protoplast-mediated transformation has been disclosed for Japonica-types and Indica-types (Zhang et al., 1988; Shimamoto et al., 1989; Datta et al., 1990). Both types are also routinely transformable using particle bombardment (Christou et al., 1991). Furthermore, WO 93/21335 describes techniques for the transformation of rice via electroporation.

Patent Application EP 0 332 581 describes techniques for the generation, transformation, and regeneration of *Pooideae* protoplasts. These techniques allow the transformation of *Dactylis* and wheat. Furthermore, wheat transformation has been disclosed in Vasil et al., 1992 using particle bombardment into cells of type C long-term regenerable callus, and also by Vasil et al., 1993 and Weeks et al., 1993 using particle bombardment of immature embryos and immature embryo-derived callus.

A representative technique for wheat transformation, however, involves the transformation of wheat by particle bombardment of immature embryos and includes either a high sucrose or a high maltose step prior to gene delivery. Prior to bombardment, embryos (0.75-1 mm in length) are plated onto MS medium with 3% sucrose (Murashige & Skoog, 1962) and 3 mg/l 2,4-dichlorophenoxyacetic acid (2,4-D) for induction of somatic embryos, which is allowed to proceed in the dark. On the chosen day of bombardment, embryos are removed from the induction medium and placed onto the osmoticum (i.e. induction medium with sucrose or maltose added at the desired concentration, typically 15%). The embryos are allowed to plasmolyze for 2-3 hours and are then bombarded. Twenty embryos per target plate are typical, although not critical. An appropriate gene-carrying plasmid (such as pCIB3064 or pSG35) is precipitated onto micrometer size gold particles using standard procedures. Each plate of embryos is shot with the DuPont BIOLISTICS® helium device using a burst pressure of about 1000 pounds per square inch (psi) using a standard 80 mesh screen. After bombardment, the embryos are placed back into the dark to recover for about 24 hours (still on osmoticum). After 24 hours, the embryos are removed from the osmoticum and placed back onto induction medium where they stay for about a month before regeneration. Approximately one month later the embryo explants with developing embryogenic callus are transferred to regeneration medium (MS+1 mg/liter NAA, 5 mg/liter GA), further containing the appropriate selection agent (10 mg/l BASTA® in the case of pCIB3064 and 2 mg/l methotrexate in the case of pSOG35). After approximately one month, developed shoots are transferred to larger sterile containers known as "GA7s" which contain half-strength MS, 2% sucrose, and the same concentration of selection agent.

Transformation of monocotyledons using *Agrobacterium* has also been disclosed. See WO 94/00977 and U.S. Pat. No. 5,591,616, both of which are incorporated herein by reference. See also Negrotto et al., 2000, incorporated herein by reference.

Rice (*Oryza sativa*) can be used for generating transgenic plants. Various rice cultivars can be used (Hiei et al., 1994;

Dong et al., 1996; Hiei et al., 1997). Also, the various media constituents disclosed below can be either varied in quantity or substituted. Embryogenic responses are initiated and/or cultures are established from mature embryos by culturing on MS-CIM medium (MS basal salts, 4.3 g/liter; B5 vitamins (200×), 5 ml/liter; Sucrose, 30 g/liter; proline, 500 mg/liter; glutamine, 500 mg/liter; casein hydrolysate, 300 mg/liter; 2,4-D (1 mg/ml), 2 ml/liter; pH adjusted to 5.8 with 1 N KOH; Phytagel, 3 g/liter). Either mature embryos at the initial stages of culture response or established culture lines are inoculated and co-cultivated with the *Agrobacterium tumefaciens* strain LBA4404 (*Agrobacterium*) containing the desired vector construction. *Agrobacterium* is cultured from glycerol stocks on solid YPC medium (plus 100 mg/L spectinomycin and any other appropriate antibiotic) for about 2 days at 28° C. *Agrobacterium* is re-suspended in liquid MS-CIM medium. The *Agrobacterium* culture is diluted to an $OD_{600}$ of 0.2-0.3 and acetosyringone is added to a final concentration of 200 μM. Acetosyringone is added before mixing the solution with the rice cultures to induce *Agrobacterium* for DNA transfer to the plant cells. For inoculation, the plant cultures are immersed in the bacterial suspension. The liquid bacterial suspension is removed and the inoculated cultures are placed on co-cultivation medium and incubated at 22° C. for two days. The cultures are then transferred to MS-CIM medium with ticarcillin (400 mg/liter) to inhibit the growth of *Agrobacterium*. For constructs utilizing the PMI selectable marker gene (Reed et al., 2001), cultures are transferred to selection medium containing mannose as a carbohydrate source (MS with 2% mannose, 300 mg/liter ticarcillin) after 7 days, and cultured for 3-4 weeks in the dark. Resistant colonies are then transferred to regeneration induction medium (MS with no 2,4-D, 0.5 mg/liter IAA, 1 mg/liter zeatin, 200 mg/liter TIMENTIN®, 2% mannose, and 3% sorbitol) and grown in the dark for 14 days. Proliferating colonies are then transferred to another round of regeneration induction media and moved to the light growth room. Regenerated shoots are transferred to GA7 containers with GA7-1 medium (MS with no hormones and 2% sorbitol) for 2 weeks and then moved to the greenhouse when they are large enough and have adequate roots. Plants are transplanted to soil in the greenhouse ($T_0$ generation) grown to maturity and the $T_1$ seed is harvested.

3. Transformation of Plastids

Seeds of *Nicotiana tabacum* c.v. 'Xanthi nc' are germinated seven per plate in a 1" circular array on T agar medium and bombarded 12-14 days after sowing with 1 μm tungsten particles (M10; Biorad Laboratories, Hercules, Calif., United States of America) coated with DNA from plasmids pPH143 and pPH145 essentially as disclosed (Svab & Maliga, 1993). Bombarded seedlings are incubated on T medium for two days after which leaves are excised and placed abaxial side up in bright light (350-500 μmol photons/m²/s) on plates of RMOP medium (Svab et al., 1990) containing 500 μg/ml spectinomycin dihydrochloride (Sigma, St. Louis, Mo., United States of America). Resistant shoots appearing underneath the bleached leaves three to eight weeks after bombardment are subcloned onto the same selective medium, allowed to form callus, and secondary shoots isolated and subcloned. Complete segregation of transformed plastid genome copies (homoplasmicity) in independent subclones is assessed by standard techniques of Southern blotting (Sambrook & Russell, 2001). BamH I/EcoR I-digested total cellular DNA (Mettler, 1987) is separated on 1% Tris-borate-EDTA (TBE) agarose gels, transferred to nylon membranes (Amersham Biosciences, Piscataway, N.J., United States of America) and probed with $^{32}$P-labeled random primed DNA sequences corresponding to a 0.7 kb BamH I/Hind III DNA fragment from pC8 containing a portion of the rps7/12 plastid targeting sequence. Homoplasmic shoots are rooted aseptically on spectinomycin-containing MS/IBA medium (McBride et al., 1994) and transferred to the greenhouse.

V. PLANTS, BREEDING, AND SEED PRODUCTION

A. Plants

The presently disclosed subject matter also provides plants comprising the disclosed compositions. In some embodiments, the plant is characterized by a modification of a phenotype or measurable characteristic of the plant, the modification being attributable to the expression cassette. In some embodiments, the modification involves, for example, nutritional enhancement, increased nutrient uptake efficiency, enhanced production of endogenous compounds, or production of heterologous compounds. In some embodiments, the modification includes having increased or decreased resistance to an herbicide, an abiotic stress, or a pathogen. In some embodiments, the modification includes having enhanced or diminished requirement for light, water, nitrogen, or trace elements. In some embodiments, the modification includes being enriched for an essential amino acid as a proportion of a polypeptide fraction of the plant. In some embodiments, the polypeptide fraction can be, for example, total seed polypeptide, soluble polypeptide, insoluble polypeptide, water-extractable polypeptide, and lipid-associated polypeptide. In some embodiments, the modification includes overexpression, underexpression, antisense modulation, sense suppression, inducible expression, inducible repression, or inducible modulation of a gene.

B. Breeding

The plants obtained via transformation with a nucleic acid sequence of the presently disclosed subject matter can be any of a wide variety of plant species, including monocots and dicots; however, the plants used in the method for the presently disclosed subject matter are selected in some embodiments from the list of agronomically important target crops set forth hereinabove. The expression of a gene of the presently disclosed subject matter in combination with other characteristics important for production and quality can be incorporated into plant lines through breeding. Breeding approaches and techniques are known in the art. See e.g., Welsh, 1981; Wood, 1983; Mayo, 1987; Singh, 1986; Wricke & Weber, 1986.

The genetic properties engineered into the transgenic seeds and plants disclosed above are passed on by sexual reproduction or vegetative growth and can thus be maintained and propagated in progeny plants. Generally, said maintenance and propagation make use of known agricultural methods developed to fit specific purposes such as tilling, sowing, or harvesting. Specialized processes such as hydroponics or greenhouse technologies can also be applied. As the growing crop is vulnerable to attack and damage caused by insects or infections as well as to competition by weed plants, measures are undertaken to control weeds, plant diseases, insects, nematodes, and other adverse conditions to improve yield. These include mechanical measures such as tillage of the soil or removal of weeds and infected plants, as well as the application of agrochemicals such as herbicides, fungicides, gametocides, nematicides, growth regulants, ripening agents, and insecticides.

Use of the advantageous genetic properties of the transgenic plants and seeds according to the presently disclosed subject matter can further be made in plant breeding, which aims at the development of plants with improved properties such as tolerance of pests, herbicides, or abiotic stress, improved nutritional value, increased yield, or improved structure causing less loss from lodging or shattering. The various breeding steps are characterized by well-defined human intervention such as selecting the lines to be crossed, directing pollination of the parental lines, or selecting appropriate progeny plants.

Depending on the desired properties, different breeding measures are taken. The relevant techniques are well known in the art and include, but are not limited to, hybridization, inbreeding, backcross breeding, multiline breeding, variety blend, interspecific hybridization, aneuploid techniques, etc. Hybridization techniques can also include the sterilization of plants to yield male or female sterile plants by mechanical, chemical, or biochemical means. Cross-pollination of a male sterile plant with pollen of a different line assures that the genome of the male sterile but female fertile plant will uniformly obtain properties of both parental lines. Thus, the transgenic seeds and plants according to the presently disclosed subject matter can be used for the breeding of improved plant lines that, for example, increase the effectiveness of conventional methods such as herbicide or pesticide treatment or allow one to dispense with said methods due to their modified genetic properties. Alternatively new crops with improved stress tolerance can be obtained, which, due to their optimized genetic "equipment", yield harvested product of better quality than products that were not able to tolerate comparable adverse developmental conditions (for example, drought).

C. Seed Production

Embodiments of the presently disclosed subject matter also provide seed and isolated product from plants that comprise an expression cassette comprising a promoter sequence operatively linked to an isolated nucleic acid, the nucleic acid sequence being selected from the group consisting of:
  (a) a nucleotide sequence listed in odd numbered sequences of SEQ ID NOs: 1-195, or fragment, domain, or feature thereof;
  (b) a nucleotide sequence encoding a polypeptide of even numbered sequences of SEQ ID NOs: 2-196, or a functional fragment, domain or feature thereof;
  (c) a nucleotide sequence having substantial identity to (a) or (b);
  (d) a nucleotide sequence capable of hybridizing to (a), (b) or (c) under medium stringency;
  (e) a nucleotide sequence complementary (for example, fully complementary) to (a), (b), (c) or (d); and
  (f) a nucleotide sequence that is the reverse complement (for example, its full reverse complement) of (a), (b), (c) or (d) according to the present disclosure.

In some embodiments the isolated product comprises an enzyme, a nutritional polypeptide, a structural polypeptide, an amino acid, a lipid, a fatty acid, a polysaccharide, a sugar, an alcohol, an alkaloid, a carotenoid, a propanoid, a steroid, a pigment, a vitamin, or a plant hormone.

Embodiments of the presently disclosed subject matter also relate to isolated products produced by expression of an isolated nucleic acid containing a nucleotide sequence selected from the group consisting of:
  (a) a nucleotide sequence listed in odd numbered sequences of SEQ ID NOs: 1-195, or a functional fragment, domain, or feature thereof;
  (b) a nucleotide sequence encoding a polypeptide listed in even numbered sequences of SEQ ID NOs: 2-196, or a functional fragment, domain, or feature thereof;
  (c) a nucleotide sequence having substantial identity to (a) or (b);
  (d) a nucleotide sequence capable of hybridizing to (a) or (b) under medium stringency;
  (e) a nucleotide sequence complementary (for example, fully complementary) to (a), (b), (c) or (d); and
  (f) a nucleotide sequence that is the reverse complement (for example, its full reverse complement) of (a), (b) (c) or (d) according to the present disclosure.

In some embodiments, the product is produced in a plant. In some embodiments, the product is produced in cell culture. In some embodiments, the product is produced in a cell-free system. In some embodiments, the product comprises an enzyme, a nutritional polypeptide, a structural polypeptide, an amino acid, a lipid, a fatty acid, a polysaccharide, a sugar, an alcohol, an alkaloid, a carotenoid, a propanoid, a steroid, a pigment, a vitamin, or a plant hormone. In some embodiments, the product is a polypeptide comprising an amino acid sequence listed in even numbered sequences of SEQ ID NOs: 2-196. In some embodiments, the polypeptide comprises an enzyme.

In seed production, germination quality and uniformity of seeds are essential product characteristics. As it is difficult to keep a crop free from other crop and weed seeds, to control seedborne diseases, and to produce seed with good germination, fairly extensive and well-defined seed production practices have been developed by seed producers who are experienced in the art of growing, conditioning, and marketing of pure seed. Thus, it is common practice for the farmer to buy certified seed meeting specific quality standards instead of using seed harvested from his own crop. Propagation material to be used as seeds is customarily treated with a protectant coating comprising herbicides, insecticides, fungicides, bactericides, nematicides, molluscicides, or mixtures thereof. Customarily used protectant coatings comprise compounds such as captan, carboxin, thiram (tetramethylthiuram disulfide; TMTD®; available from R. T. Vanderbilt Company, Inc., Norwalk, Conn., United States of America), methalaxyl (APRON XL®; available from Syngenta Corp., Wilmington, Del., United States of America), and pirimiphos-methyl (ACTELLIC®; available from Agriliance, LLC, St. Paul, Minn., United States of America). If desired, these compounds are formulated together with further carriers, surfactants, and/or application-promoting adjuvants customarily employed in the art of formulation to provide protection against damage caused by bacterial, fungal, or animal pests. The protectant coatings can be applied by impregnating propagation material with a liquid formulation or by coating with a combined wet or dry formulation. Other methods of application are also possible such as treatment directed at the buds or the fruit.

VI. OTHER APPLICATIONS

The presently disclosed subject matter also provides a method for altering an abiotic stress tolerance of a plant, the method comprising expressing in the plant an expression cassette comprising a nucleic acid molecule encoding a polypeptide as disclosed herein. In some embodiments, the method alters the drought resistance of the plant.

Also provided is a method for enhancing the drought resistance of a plant, the method comprising (a) inserting into the plant an expression cassette comprising at least one isolated nucleic acid molecule of the presently disclosed subject matter; and (b) growing the plant comprising the expression cassette under suitable growth conditions, wherein the drought resistance of the plant is enhanced.

Also provided is a method for producing a polypeptide as disclosed herein, the method comprising (a) growing cells comprising an expression cassette under suitable growth conditions, the expression cassette comprising a nucleic acid molecule encoding the polypeptide; and (b) isolating the polypeptide from the cells.

Also provided is a method for producing a plant comprising a modification thereto, including the steps of: (1) providing a nucleic acid comprising a nucleotide sequence selected from the group consisting of:
  (a) a nucleotide sequence listed in odd numbered sequences of SEQ ID NOs: 1-195, or exon, domain, or feature thereof;
  (b) a nucleotide sequence having substantial identity to (a);
  (c) a nucleotide sequence capable of hybridizing to (a) under medium stringency;
  (d) a nucleotide sequence complementary (for example, fully complementary) to (a), (b) or (c); and
  (e) a nucleotide sequence which is the reverse complement (for example, its full reverse complement) of (a), (b) or (c); and (2) introducing the nucleic acid into the plant, wherein the nucleic acid is expressible in the plant in an amount effective to effect the modification. In some embodiments, the modification comprises an altered trait in the plant, wherein the trait corresponds to the nucleic acid introduced into the plant. In other embodiments, the altered trait is related to a feature listed in any of Tables 1-6. For example, the trait can correspond to disease resistance, yield, abiotic stress tolerance, nutritional composition, carbon metabolism, photosynthesis, signal transduction, cell growth, reproduction, a disease process, or differentiation.

In some embodiments, the modification comprises an increased or decreased expression or accumulation of a product of the plant. In some embodiments, the product comprises a natural product of the plant. In some embodiments, the product comprises a new or altered product of the plant. In some embodiments, the product comprises an enzyme, a nutritional polypeptide, a structural polypeptide, an amino acid, a lipid, a fatty acid, a polysaccharide, a sugar, an alcohol, an alkaloid, a carotenoid, a propanoid, a steroid, a pigment, a vitamin, or a plant hormone. In some embodiments, the presently disclosed subject matter provides a method for increasing drought resistance by delivering an effective amount of a product resulting from modification of the plant.

Also encompassed within the presently disclosed subject matter is a method for producing a recombinant polypeptide, the method comprising:
  (a) growing recombinant cells comprising a nucleic acid construct under suitable growth conditions, the construct comprising an expression vector and a nucleic acid comprising a nucleic acid encoding a polypeptide as listed in even numbered nucleotide sequences of SEQ ID NOs: 2-196, or a nucleic acid sequence listed in odd numbered nucleotide sequences of SEQ ID NOs: 1-195, or a subsequence thereof; and
  (b) isolating from the recombinant cells the recombinant polypeptide expressed thereby.

Embodiments of the presently disclosed subject matter provide a method for producing a recombinant polypeptide in which the expression vector comprises one or more elements including, but not limited to, a promoter-enhancer sequence, a selection marker sequence, an origin of replication, an epitope tag-encoding sequence, and an affinity purification tag-encoding sequence. In some embodiments, the nucleic acid construct comprises an epitope tag-encoding sequence and the isolating step employs an antibody specific for the epitope tag. In some embodiments, the nucleic acid construct comprises a polyamino acid-encoding sequence and the isolating step employs a resin comprising a polyamino acid binding substance. In some embodiments, the polyamino acid comprises polyhistidine and the polyamino acid binding resin comprises nickel-charged agarose resin. In some embodiments, the nucleic acid construct comprises a polypeptide-encoding sequence and the isolating step employs a resin containing a polypeptide binding substance. In some embodiments, the polypeptide comprises a chitin binding domain and the resin comprises chitin-SEPHAROSE™.

The presently disclosed subject matter also provides a method for altering the expression of a polypeptide of the presently disclosed subject matter in a plant, the method comprising expressing an expression cassette encoding a polypeptide of the presently disclosed subject matter in the plant. In some embodiments, the polypeptide is expressed in a predetermined location or tissue of a plant. In some embodiments, the location or tissue is selected from the group consisting of epidermis, root, vascular tissue, meristem, cambium, cortex, pith, leaf, flower, seed, and combinations thereof.

The presently disclosed subject matter also provides a method for decreasing the expression of an isolated nucleic acid molecule as disclosed herein in a plant, the method selected from the group consisting of (a) expressing in said plant a molecule of the presently disclosed subject matter or a portion thereof in "sense" orientation; (b) expressing in said plant a molecule of the presently disclosed subject matter or a portion thereof in "antisense" orientation; (c) expressing in said plant a ribozyme capable of specifically cleaving a messenger RNA transcript encoded by an endogenous gene corresponding to an isolated nucleic acid molecule of the presently disclosed subject matter; (d) expressing in a plant an aptamer specifically directed to a polypeptide encoded by an isolated nucleic acid molecule of the presently disclosed subject matter; (e) expressing in a plant a mutated or a truncated form of an isolated nucleic acid molecule of the presently disclosed subject matter; (f) modifying by homologous recombination in a plant at least one chromosomal copy of the gene corresponding to an isolated nucleic acid molecule of the presently disclosed subject matter; (g) modifying by homologous recombination in a plant at least one chromosomal copy of the regulatory elements of a gene corresponding to an isolated nucleic acid molecule of the presently disclosed subject matter; and (h) expressing in said plant an isolated nucleic acid molecule of the presently disclosed subject matter or a portion thereof in the "sense" and "antisense" orientation.

Embodiments of the presently disclosed subject matter also relate to a method for increasing the expression of an isolated nucleic acid molecule of the presently disclosed subject matter in a plant, the method comprising (a) inserting into the plant an expression cassette comprising an isolated nucleic acid molecule of the presently disclosed subject matter; and (b) growing the plant comprising the expression cassette under suitable growth conditions, wherein the expression of the isolated nucleic acid molecule of the presently disclosed subject matter is increased.

Embodiments of the presently disclosed subject matter also relate to a plant modified by a method that comprises introducing into the plant a nucleic acid where the nucleic acid is expressible in the plant in an amount effective to effect the modification. The modification can be, for example, nutritional enhancement, increased nutrient uptake efficiency, enhanced production of endogenous compounds, and production of heterologous compounds. In some embodiments, the modified plant has increased or decreased resistance to a herbicide, an abiotic stress, or a pathogen. In some embodiments, the modified plant has enhanced or diminished requirement for light, water, nitrogen, or trace elements. In some embodiments, the modified plant is enriched for an essential amino acid as a proportion of a polypeptide fraction of the plant. The polypeptide fraction can be, for example, total seed polypeptide, soluble polypeptide, insoluble polypeptide, water-extractable polypeptide, and lipid-associated polypeptide. The modification can include, but is not limited to, overexpression, underexpression, antisense modulation, sense suppression, inducible expression, inducible repression, or inducible modulation of a gene.

The presently disclosed subject matter further relates to a seed from a modified plant or an isolated product of a modified plant, wherein the product includes, but is not limited to, an enzyme, a nutritional polypeptide, a structural polypeptide, an amino acid, a lipid, a fatty acid, a polysaccharide, a sugar, an alcohol, an alkaloid, a carotenoid, a propanoid, a steroid, a pigment, a vitamin, or a plant hormone.

The presently disclosed subject matter will be further disclosed by reference to the following detailed examples. These examples are provided for purposes of illustration only, and are not intended to be limiting unless otherwise specified.

EXAMPLES

The following Examples have been included to illustrate modes of the presently disclosed subject matter. Certain aspects of the following Examples are described in terms of techniques and procedures found or contemplated by the present co-inventors to work well in the practice of the presently disclosed subject matter. These Examples illustrate standard laboratory practices of the co-inventors. In light of the present disclosure and the general level of skill in the art, those of skill will appreciate that the following Examples are intended to be exemplary only and that numerous changes, modifications, and alterations can be employed without departing from the scope of the presently disclosed subject matter.

Standard recombinant DNA and molecular cloning techniques used here are well known in the art and are disclosed in Silhavy et al., 1984; Reiter et al., 1992; Schultz et al., 1998; Sambrook & Russell, 2001; Ausubel et al., 2002; and Ausubel et al., 2003.

Example 1

Plant Material and Stress Treatment

A double haploid (DH) population was derived from a cross of CT9993-5-10-1-M (hereinafter "CT9993"), an *O. sativa* spp. *japonica* upland accession with a low osmotic adjustment capacity, with IR6226642-6-2 (hereinafter "IR62266"), an *O. sativa* spp. *indica* accession with high osmotic adjustment capacity (Zhang et al., 2001). These accessions are available from the International Rice Research Institute (Los Banos, Laguna, Philippines, via mailing address DAPO Box 7777, Metro Manila, Philippines). The two parental lines and DH lines with the 20 highest osmotic adjustment (HOADH02, HOADH65, HOADH98) and the lowest osmotic adjustment (LOADH47 and LOADH120) were used. Plants were grown in the greenhouse in a randomized complete block design with three replicates. Two rice seedlings were grown in five-gallon plastic pots filled with Ball Growing Mix (Ball Seed Co., Chicago, Ill., United States of America), three pots per replicate. Water was applied every other day and fertilizer (available under the registered trademark MIRACLE-GRO®, and available from The Scotts Company, Marysville, Ohio, United States of America) was applied with water every two weeks. The last irrigation was administered 55 days after transplanting. Gradual water deficit treatment was imposed to represent natural drought conditions. Fully expanded second young rice leaf tissues were collected at full irrigation (about 95% leaf relative water content; RWC), moderate dehydration stress (MDS; about 80% leaf RWC), and at severe dehydration stress (SDS; about 65% leaf RWC). Sampling started 56 days after transplanting (maximum tillering stage) and continued up to 79 days after transplanting. Four to six plants were repeatedly sampled at both moderate and severe stress per replicate. Average greenhouse day conditions were 32° C., 43% humidity, 13-hour day length, 825 µE m$^{-2}$ sec$^{-1}$ light intensity. Average greenhouse night temperature was 27° C.

Example 2

Expression Profiling

Probe preparation, hybridization, and normalization procedures were conducted as previously disclosed (Zhu et al., 2003). Briefly, total RNA was isolated from a 300 µl volume of ground, liquid nitrogen freeze-dried tissue using the RNAWIZ™ reagent (Ambion, Austin, Tex., United States of America). Double stranded cDNAs were synthesized from total RNA using an oligo dT$_{(24)}$ primer containing a 5' T7 RNA polymerase promoter sequence and SUPERSCRIPT™ II Reverse Transcriptase (Invitrogen Corp., Carlsbad, Calif., United States of America). Double stranded cDNAs were purified following second strand synthesis. Biotinylated complementary RNAs (cRNAs) were transcribed in vitro from synthesized cDNA using T7 RNA polymerase (ENZO Biochem, New York, N.Y., United States of America). Labeled cRNAs were hybridized to a rice GENECHIP® microarray (Affymetrix, Santa Clara, Calif., United States of America).

The GENECHIP® contained probe sets for about 21,000 rice genes designed from computational predictions of the *O. sativa* spp. *japonica* genome sequence (Goff et al., 2002) and expressed sequence tag and polypeptide sequences. Expression data were normalized globally prior to data analysis. Genes with accurately detectable transcript levels were defined by probe sets showing averaged expression levels equal to or greater than 50 and those with lesser signals were adjusted to 50. The change in expression was calculated as a fold-change difference from well-watered plants to increasing dehydration stress. A two-fold or greater change cut-off was used to reduce false positives due to technical variation, which is expected to occur at a rate of less than 0.5% (Zhu et al., 2003). The complete probe set sequence and expression values are presented in Table 1.

TABLE 1

Functional Categorization According to the MIPS Classification Scheme of Transcripts with 2-fold Expression Differences in IR62266 and CT9993 in Response to Dehydration Stress

| Number Induced | Number Repressed | Major and Minor Functional Categories |
| --- | --- | --- |
| 34(16) | 7 | Cell growth, cell division and DNA synthesis |
| 33(15) | 10 | Ionic homeostasis |
| 33(15) | 10 | Ionic homeostasis |
| 48(22) | 10 | Protein destination |
| 6 | 0 | Proteolysis |
| 118(54) | 12 | Protein synthesis |
| 59 | 2 | Ribosomal proteins |
| 52(24) | 14 | Transcription |
| 18(8) | 17 | Cellular biogenesis |
| 8 | 12 | Biogenesis of cell wall (cell envelope) |
| 4 | 1 | Biogenesis of plasma membrane |
| 21(10) | 13 | Development |
| 47(22) | 11 | Cellular transport and transport mechanisms |
| 30(14) | 28 | Cellular communication/signal transduction |

TABLE 1-continued

Functional Categorization According to the MIPS Classification Scheme of Transcripts with 2-fold Expression Differences in IR62266 and CT9993 in Response to Dehydration Stress

| Number Induced | Number Repressed | Major and Minor Functional Categories |
|---|---|---|
| 30(14) | 21 | Transport facilitation |
| 62(29) | 31 | Cell rescue, defense, cell death and ageing |
| 33 | 10 | Stress response |
| 38(17) | 39 | Energy |
| 6 | 6 | Electron transport |
| 0 | 7 | Photosynthesis |
| 205(94) | 69 | Cellular organization |
| 14 | 27 | Chloroplast organization |
| 5 | 2 | Mitochondrial organization |
| 13 | 5 | Nuclear organization |
| 6 | 1 | Organization of cytoplasm |
| 5 | 1 | Vacuolar and lysosomal organization |
| 2 | 0 | Extracellular/secretion proteins |
| 2 | 0 | Organization of intracellular transport vesicles |
| 89(41) | 65 | Metabolism |
| 825 | 347 | Total |
| 170 | 188 | Classification unknown |
| 509 | 234 | Unclassified proteins |
| 72 | 35 | Classification not yet clear-cut |

Note:
Numbers in parentheses are normalized to the total number of down regulated genes in order to make proportional comparisons.

A sample was hybridized to two different genome arrays manufactured on the same silicon wafer to assess the reproducibility of the rice microarray (Figure S1, Zhu et al., 2003). In the same study, the expression values of multiple probe sets were confirmed by quantitative reverse transcription polymerase chain reaction (RT-PCR; see Figure S2, Zhu et al., 2003). Each transcript was assigned to functional categories based on the Munich Information Center for Protein Sequences (MIPS) classification scheme (Schoof et al., 2002). The scheme includes hierarchical structures of polypeptide functions, enzymatic activities, and pathways. In order to classify a sequence according to the scheme, the sequence was compared to currently classified polypeptide sequences using FASTX and FASTX-i. The top hits from these searches were parsed based on a 200 cut-off z-score. The sequence was then assigned with the same hierarchical classification as the top hits.

Example 3

Quantitative Trait Loci (QTL) Interval Open Reading Frames

Candidate genes corresponding to the QTL intervals were identified through a comparative analysis of the IR62266/CT9993 genetic map (Zhang et al., 2001), the Rice Genome Research Program of Japan genetic map (available via the World Wide Web), and the draft sequence of the rice genome, the latter of which was annotated using several gene prediction algorithms (Goff et al., 2002). The sequences of many of the mapped cDNA clones were matched to the assembled genome sequence. Predicted open reading frames within the QTL intervals were extracted for five osmotic adjustment QTLs (Zhang et al., 2001).

Example 4

General Changes in Gene Expression in Response to Dehydration

Gene expression profiling was employed with GENE-CHIP® microarrays and phenotypically divergent accessions and their transgressive segregants. There was an appreciable difference in overall transcriptional responses of the high osmotic adjustment (OA) and low OA lines exposed to dehydration stress. Between the parental lines, IR62266 and CT9993, a total of 1210 transcripts exhibited a greater than two-fold change in expression in response to dehydration stress. A majority of those, 752, increased in abundance and 458 transcripts diminished. Seventy-five probes were either induced or repressed depending on the accession and stage of dehydration being tested. Differentially expressed transcripts were classified according to the MIPS *Arabidopsis thaliana* Database (MatDB; Schoof et al., 2002; Schoof et al., 2004) polypeptide functional categories (Schoof et al., 2002) as shown in Table 1. In many cases, genes were assigned to multiple categories. For example, a putative oxalate oxidase (similar to Swiss-Prot Accession Number P45851; oxalate oxidase precursor/germin) was classified as "cell rescue, defense, cell death and aging", "cellular biogenesis", "development", "energy", "metabolism", "unclassified polypeptide", and "classification not yet clear-cut".

There was a greater occurrence of upregulated rather than downregulated changes for each major functional category in response to dehydration stress with the exception of "energy" (Table 2). "Energy" subcategories indicate a bidirectional change in transcription of electron transport associated genes and down regulation of photosynthesis. "Cellular biogenesis" function was proportionally more reduced than induced. Genes with "biogenesis of cell wall (cell envelope)" associated function were both induced and repressed. Genes with the sub-category function "biogenesis of the plasma membrane" were induced four times and repressed once.

The greatest proportional difference between up and down regulated functions was "polypeptide synthesis" and "cellular organization". "Polypeptide synthesis" mostly included the sub-categories "ribosomal polypeptides" and "translation". Within "cellular organization", "chloroplast organization" was down regulated, while all other forms of cellular organization increased in abundance.

TABLE 2

Phenotypic and Genotypic Characterization of Mapping Parents and Five Transgressive Segregant Double Haploid Lines

| | RWC | | | oa1.1* | | oa2.1 | | oa3.1 | | oa8.1 | | oa9.1 | |
| | Well Watered | Severe-stress | OA | | | | | | | | | | |
| Accession | % | | M pa | ME2_12 - | RG140 | RM263 - | R3393 | EM17_1 - | C63 | G2163 - | R1394A | E14_6 - | ME4_13 |
| IR62266 | 96 | 64 | 0.78 | + | + | + | + | + | + | + | + | + | + |
| CT9993 | 95 | 63 | 0.47 | − | − | − | − | − | − | − | − | − | − |
| HOADH65 | 96 | 65 | 0.98 | + | + | + | + | + | + | + | n.d. | − | − |

TABLE 2-continued

Phenotypic and Genotypic Characterization of Mapping Parents and Five Transgressive Segregant Double Haploid Lines

| | RWC | | | oa1.1* | | oa2.1 | | oa3.1 | | oa8.1 | | oa9.1 | |
| | Well Watered | Severe-stress | OA | | | | | | | | | | |
| Accession | % | % | M pa | ME2_12 - | RG140 | RM263 - | R3393 | EM17_1 - | C63 | G2163 - | R1394A | E14_6 - | ME4_13 |
|---|---|---|---|---|---|---|---|---|---|---|---|---|---|
| HOADH98 | 94 | 64 | 0.96 | + | + | + | + | + | + | + | + | − | − |
| HOADH02 | 95 | 64 | 0.91 | nd | + | + | + | + | + | + | + | + | + |
| LOADH47 | 95 | 66 | 0.24 | − | − | − | + | − | − | − | n.d. | − | − |
| LOADH120 | 96 | 61 | 0.29 | + | − | − | − | − | − | + | + | − | − |

*Zhang et al. (2001);
+ = IR62266 allele;
− = CT9993 allele;
nd = data not available

Example 5

Difference in Response Between IR62266 and CT9993

The phenotypic responses to dehydration stress of the two parental lines, IR62266 and CT9993, were very different (Table 2). The RWCs of the accessions were similar at both well watered (WW) and SDS state; IR62266 was able to maintain high turgor pressure (MPa) measured as osmotic adjustment. On the contrary, CT9993 did not and is considered sensitive to dehydration stress.

In addition to differences in osmotic adjustment, the two parental accessions also had very different transcriptional responses to dehydration stress (Table 3). Changes in gene expression from fully hydrated plants through MDS to SDS were measured as the number of genes with greater than two-fold changes in expression. Nearly ten fold more genes were induced in IR62266 than CT9993 at MDS. The only instance where there was a greater number of genes differentially expressed in CT9993 than in IR62266 was during the transition from MDS to SDS. Fifty genes were induced, none of which was the same as any of the IR62266 induced genes. Only 88 genes were differentially expressed in the low osmotic adjusting line, CT9993, from well watered to SDS, whereas 916 changes in expression were observed in IR62266. Most of the transcriptional changes that occurred were not shared between the two parental lines.

TABLE 3

Number of Genes with a Two-fold Change in Expression Among and within Groups of Drought Tolerant and Sensitive Rice Accessions*

| | Moderate Dehydration Stress | | Severe Dehydration Stress[a] | | Severe Dehydration Stress[b] | |
|---|---|---|---|---|---|---|
| Accession | up-regulated | down-regulated | up-regulated | down-regulated | up-regulated | down-regulated |
| IR62266 | 401 | 165 | 31 | 126 | 592 | 324 |
| CT9993 | 44 | 41 | 50 | 111 | 9 | 79 |
| HOADH02 | n.d. | n.d. | n.d. | n.d. | 822 | 635 |
| HOADH65 | 502 | 540 | 654 | 257 | 1010 | 579 |
| HOADH98 | n.d. | n.d. | n.d. | n.d. | 681 | 596 |
| LOADH47 | 52 | 60 | 401 | 357 | 417 | 396 |
| LOADH120 | 500 | 201 | 115 | 109 | 584 | 312 |
| IR62266 not CT9993 | 396 | 161 | 396 | 161 | 592 | 262 |
| CT9993 not IR62266 | 39 | 37 | 39 | 37 | 9 | 17 |
| IR62266 and CT9993 | 5 | 4 | 5 | 4 | 0 | 62 |
| HOA lines | 188(2) | 117(2) | 2(2) | 47(2) | *117(4) | 191(4) |
| HOA lines only | 89(2) | 45(2) | 0(2) | 2(2) | 14(4) | 28(4) |
| LOA line | 0(3) | 3(3) | 0(3) | 8(3) | 0(3) | 33(3) |
| LOA lines only | 0(3) | 0(3) | 0(3) | 0(3) | 0(3) | 0(3) |
| All lines | 0(5) | 0(5) | 0(5) | 5(5) | 0(7) | 32(7) |

Note:
parentheses denote sample size where comparisons among multiple accessions were made
[a] number of two-fold changes in gene expression from moderate to severe dehydration stress
[b] number of two-fold changes in gene expression from well watered to severe dehydration stress

Example 6

Double Haploid Transgressive Segregant Response to Dehydration Stress

The lines with the most extreme OA phenotype were selected from the DH population derived from a cross between IR62266 and CT9993. Three high osmotic adjusting double haploid (HOADH) lines (numbers 65, 98, and 02) had an average OA of 0.95 MPa, a higher value than the high OA parent, IR62266, had (0.78 Mpa; Table 2). Two low osmotic adjusting double haploid (LOADH) lines (numbers 47 and 120) had a very low average response (0.27 MPa) to dehydration stress relative to the low OA parent, CT9993 (0.47 MPa). A greater number of transcriptional changes, both up and down, occurred in the HOADHs than occurred in IR62266 (Table 3). While fewer genes were differentially expressed in the LOADHs than with the HOADHs, there were many more changes than occurred in CT9993. None of the induced genes was common to all the non-OA lines and therefore none of the seven lines shared a single induced gene in common across all treatments. A handful of genes (n=33) were commonly repressed in all accessions when well-watered and severe dehydration stressed plants were compared. Many of these were classified into "energy" or "disease resistance" functional categories, but most were unclassified. The HOADHs had several common responses, both inductions and repressions (Table 3).

There were many differentially expressed genes in common among the high OA lines. The 98 genes with increased expression at SDS in all the high OA lines are disclosed in Table 4. Fourteen of those genes were induced in all high OA lines and not in any of the low OA lines. The annotations of two of those genes suggest a regulatory effect on high OA: polyadenylate-binding polypeptide (OS015643.1_at) and PP2A regulatory subunit (OS015052_at). Annotations of several of the other 12 genes suggest an OA mechanistic role, including 3-hydroxybutyryl-CoA dehydrogenase (OS009133_at), a putative abscisic acid-inducible LEA (OS012297_f_at), pyrroline-5-carboxylate synthetase (OS016193_at), raffinose synthase (OS008342_at), and Rieske Fe—S polypeptide (OS00661_at).

Example 7

Expression Profile of QTL Interval Genes

For each of the five OA QTL intervals, predicted genes were determined from the rice genome sequence. One cM of the QTL intervals contains an average of 180 genes and 1.3 Mb of DNA (Table 5). The RGP map, which accounts for considerably more recombination events, has approximately eight fold fewer genes per cM. The number of genes predicted to be in each interval ranged from 891 (oa2.1) to 1636 (oa9.1). A majority of the predicted genes found in each interval were represented as probes on the GENECHIP® microarray. Of the many probe sets that

TABLE 4

Fold-Change Expression Values of the Greater Than Two-Fold Differentially Regulated Transcripts in All the High OA Lines

| | | Fold change from WW to SDS | | | | |
|---|---|---|---|---|---|---|
| Probe Set | SEQ ID No. | IR62266 | HOADH 65 | HOADH 98 | HOADH 02 | Description, putative function | QTL* |
| HNOs1 | 1 | 7.6 | 3 | 3.6 | 2.6 | Hypothetical protein | |
| HNOs2 | 3 | 2.7 | 2.6 | 2.1 | 2.7 | Unknown protein | |
| HNOs3 | 5 | 5.1 | 4.1 | 5 | 8.4 | Osr40g2 protein | |
| HNOs4 | 7 | 7.6 | 10.7 | 8.0 | 5.7 | Heat shock protein | oa3.1 |
| HNOs5 | 9 | 2.6 | 2.2 | 2.7 | 2.8 | Ubiquitin ligase Rbx1 | |
| HNOs6 | 11 | 3.3 | 5.9 | 3.4 | 18.9 | Bowman Birk trypsin inhibitor | |
| HNOs7 | 13 | 2.5 | 3.5 | 3.0 | 5.2 | Heat shock protein | oa3.1 |
| HNOs8 | 15 | 3.5 | 3.3 | 2.9 | 4.2 | Superoxide dismutase | |
| HNOs9 | 17 | 4.5 | 5.3 | 2.9 | 5.3 | Mitochondrial precursor, putative | |
| HNOs10 | 19 | 4.8 | 2.1 | 2.2 | 2.9 | Rieske Fe-S protein | |
| HNOs11 | 21 | 4.2 | 4.9 | 3.4 | 9.2 | Superoxide dismutase | |
| HNOs12 | 23 | 3.6 | 4.2 | 2.1 | 5.7 | Chloroplast, hsc70 | |
| HNOs13 | 25 | 3.1 | 7.0 | 2.4 | 8.2 | Chloroplast, hsp70 | |
| HNOs14 | 27 | 3.9 | 3.7 | 5.5 | 9.3 | Oxalate oxidase | |
| HNOs15 | 29 | 2.7 | 5.1 | 6.4 | 3.6 | Beta-tubulin | |
| HNOs16 | 31 | 2.5 | 5.2 | 4.4 | 7.3 | Mitochondrial precursor, aconitate hydratase | |
| HNOs17 | 33 | 3.1 | 6.2 | 2.4 | 3.6 | Glyceraldehyde 3-phosphate dehydrogenase, cytosolic | |
| HNOs18 | 35 | 5.2 | 3.5 | 3.0 | 7.9 | Lea | oa1.1 |
| HNOs19 | 37 | 8.7 | 2.1 | 2.9 | 11.3 | Dehydrin rab | |
| HNOs20 | 39 | 2.6 | 7.9 | 4.8 | 2.5 | Lipid transfer | oa9.1 |
| HNOs21 | 41 | 2.6 | 2.6 | 2.1 | 2.9 | TOM7 protein, like | |
| HNOs22 | 43 | 8.8 | 19.1 | 17.4 | 79.8 | Seed maturation-associated | |
| HNOs23 | 45 | 2.9 | 4.3 | 5.1 | 3.9 | Putative chloroplast outer envelope 86-like protein | |
| HNOs24 | 47 | 53.4 | 31.9 | 36.0 | 65.2 | Dehydrin rab | |
| HNOs25 | 49 | 13.2 | 9.9 | 5.6 | 34.9 | Low temperature and salt responsive protein LTI6A | |
| HNOs26 | 51 | 30.3 | 20.2 | 18.0 | 41.7 | Dehydrin rab | |
| HNOs27 | 53 | 3.4 | 2.5 | 3.7 | 4.6 | Cysteine protease | |
| HNOs28 | 55 | 5.7 | 8.3 | 5.7 | 7.8 | Lipid transfer | |
| HNOs29 | 57 | 4.3 | 5.8 | 2.9 | 8.3 | Dehydrogenase Adh1, alcohol | |
| HNOs30 | 59 | 6.0 | 2.6 | 3.4 | 6.5 | Unknown protein | |
| HNOs31 | 61 | 3.6 | 3.7 | 2.5 | 10.6 | Lipid transfer | |
| HNOs32 | 63 | 4.2 | 3.1 | 2.4 | 2.6 | Alpha-galactosidase | |
| HNOs33 | 65 | 4.4 | 2.8 | 3.1 | 5.4 | Polyadenylate-binding protein | |

TABLE 4-continued

Fold-Change Expression Values of the Greater Than Two-Fold Differentially Regulated Transcripts in All the High OA Lines

| | | Fold change from WW to SDS | | | | |
|---|---|---|---|---|---|---|
| Probe Set | SEQ ID No. | IR62266 | HOADH 65 | HOADH 98 | HOADH 02 | Description, putative function | QTL* |
| HNOs34 | 67 | 3.8 | 3.8 | 4.6 | 5.5 | Senescence-associated | |
| HNOs35 | 69 | 3.2 | 2.0 | 2.3 | 2.3 | Ribosomal | oa3.1 |
| HNOs36 | 71 | 2.5 | 2.3 | 2.1 | 6.5 | Unknown protein | oa9.1 |
| HNOs37 | 73 | 2.7 | 33.9 | 10.3 | 13.7 | Universal stress protein 1 | |
| HNOs38 | 75 | 2.9 | 4.7 | 2.6 | 4.1 | Unknown protein | |
| HNOs39 | 77 | 2.5 | 9.4 | 7.3 | 6.3 | Cysteine protease | oa9.1 |
| HNOs40 | 79 | 2.4 | 2.6 | 3.2 | 2.1 | Ribosomal protein L35, cytosolic | |
| HNOs41 | 81 | 5.6 | 2.9 | 3.4 | 8.5 | Unknown protein | |
| HNOs42 | 83 | 3.0 | 3.0 | 2.2 | 4.1 | Chloroplast, chaperonin | |
| HNOs43 | 85 | 5.2 | 7.8 | 5.3 | 9.5 | Chloroplast, chaperonin | |
| HNOs44 | 87 | 2.5 | 2.1 | 2.8 | 2.8 | Ribosomal | |
| HNOs45 | 89 | 9.6 | 5.2 | 4.2 | 18.5 | ABA-responsive protein | |
| HNOs46 | 91 | 4.3 | 4.1 | 2.1 | 10.6 | Cold acclimation protein WCOR413-like protein | |
| HNOs47 | 93 | 2.8 | 3.4 | 3.6 | 2.3 | Unknown protein | oa3.1 |
| HNOs48 | 95 | 4.3 | 2.8 | 2.3 | 7.6 | Unknown protein | |
| HNOs49 | 97 | 3.5 | 2.8 | 2.7 | 2.5 | Proline-rich protein, putative | |
| HNOs50 | 99 | 5.3 | 3.7 | 2.9 | 3.1 | Pyrroline-5-carboxylate synthetase, probable | |
| HNOs51 | 101 | 2.7 | 3.2 | 2.3 | 3.7 | Heat shock protein | |
| HNOs52 | 103 | 2.1 | 2.3 | 2.1 | 4.7 | Unknown protein | |
| HNOs53 | 105 | 4.2 | 4.3 | 3.7 | 7.1 | EFA27 for EF hand, abscisic acid | |
| HNOs54 | 107 | 6.4 | 3.6 | 2.6 | 7.3 | Heat shock, dnak-type molecular chaperone | |
| HNOs55 | 109 | 4.9 | 3.7 | 4.4 | 4.0 | Unknown protein | |
| HNOs56 | 111 | 5.9 | 7.8 | 4.2 | 11.1 | Ferritin | |
| HNOs57 | 113 | 2.2 | 2.4 | 2.9 | 2.8 | Raffinose synthase, putative | |
| HNOs58 | 115 | 2.2 | 3.2 | 2.3 | 2.3 | Chloroplast, Tic20-like | |
| HNOs59 | 117 | 7.5 | 7.7 | 4.6 | 20.4 | Dehydrin rab | |
| HNOs60 | 119 | 2.5 | 3.7 | 2 | 2.8 | Hypothetical protein | |
| HNOs61 | 121 | 2.3 | 2.8 | 2.1 | 4.1 | 3-hydroxybutyryl-CoA dehydrogenase | |
| HNOs62 | 123 | 6.3 | 6.5 | 3.7 | 10.2 | Ferritin | |
| HNOs63 | 125 | 2.6 | 2.9 | 2.3 | 2.9 | Mitochondrial, formate dehydrogenase | |
| HNOs64 | 127 | 34.3 | 11.6 | 11.3 | 43.6 | Pore protein | oa3.1 |
| HNOs65 | 129 | 2.8 | 2.7 | 2.7 | 2.6 | Cell death suppressor protein | |
| HNOs66 | 131 | 2.3 | 2.7 | 2.1 | 5.4 | Oligouridylate binding protein | |
| HNOs67 | 133 | 2.5 | 5.7 | 4.8 | 4.4 | Initiation factor | |
| HNOs68 | 135 | 3.8 | 4.7 | 3.4 | 9.8 | Unknown protein | |
| HNOs69 | 137 | 2.8 | 2.6 | 2.4 | 4.2 | Cysteine protease, putative calcium-binding protein | |
| HNOs70 | 139 | 2.1 | 3.4 | 2.3 | 2.1 | Aldehyde dehydrogenase | oa9.1 |
| HNOs71 | 141 | 6.4 | 5.9 | 2.3 | 28.8 | Actin-depolymerizing factor | |
| HNOs72 | 143 | 11.3 | 2.1 | 2 | 5.4 | Disulfide isomerase-like protein | |
| HNOs73 | 145 | 6.0 | 9.1 | 8.1 | 15.1 | Heat shock protein | |
| HNOs74 | 147 | 3.3 | 2.8 | 2.4 | 2.8 | Dehydroascorbate reductase, GSH-dependent | |
| HNOs75 | 149 | 6.9 | 2.8 | 2.3 | 2.9 | DNA binding protein, GBF4 like leucine zipper protein | |
| HNOs76 | 151 | 4.3 | 2.9 | 2.6 | 5.9 | Homogentisate 1,2-dioxygenase | |
| HNOs77 | 153 | 2.4 | 3.1 | 2.4 | 2.6 | LEA, abscisic acid-inducible | |
| HNOs78 | 155 | 3.1 | 2.6 | 2.8 | 2.3 | Unknown protein | oa2.1 |
| HNOs79 | 157 | 3.1 | 2.6 | 2.8 | 2.5 | Xylulose kinase | |
| HNOs80 | 159 | 2.9 | 4.1 | 3.3 | 3.3 | Sodium sulfate or dicarboxylate transporter | |
| HNOs81 | 161 | 11.4 | 7.5 | 8.2 | 9.4 | Chloroplast precursor, Thioredoxin M-type | |
| HNOs82 | 163 | 2.8 | 2.3 | 2.9 | 9.1 | Reductase, ferredoxin | |
| HNOs83 | 165 | 2.1 | 2.5 | 2.8 | 3.2 | Protease ATP-binding subunit, ATP-dependent clp | |
| HNOs84 | 167 | 2.8 | 2.5 | 2.0 | 3.2 | PP2A regulatory subunit | |
| HNOs85 | 169 | 2.7 | 3.2 | 2.3 | 2.9 | Chloroplast, chaperonin | |
| HNOs86 | 171 | 2.9 | 2.5 | 2.4 | 2 | Polyadenylate-binding protein | |
| HNOs87 | 173 | 2.8 | 2.5 | 3.0 | 4.0 | Mitochondrial carrier, putative | |
| HNOs88 | 175 | 12.0 | 4.5 | 3.7 | 6.4 | Pyrroline-5-carboxylate synthetase (Delta 1) | |
| HNOs89 | 177 | 3.4 | 2 | 2.1 | 2.3 | Phosphatidic acid phosphatase | oa8.1 |
| HNOs90 | 179 | 9.9 | 5.1 | 6.1 | 2.7 | Heat shock protein | |
| HNOs91 | 181 | 2.6 | 3.0 | 2.4 | 2.8 | Unknown protein | |
| HNOs92 | 183 | 3.0 | 2.4 | 2.1 | 3.1 | Xanthine dehydrogenase - like protein | |
| HNOs93 | 185 | 2.1 | 5.0 | 2.3 | 4.3 | Mitochondrial, peroxisomal enzyme | |
| HNOs94 | 187 | 5.0 | 4.1 | 2.2 | 3.8 | Succinic semialdehyde dehydrogenase (gabd) | |
| HNOs95 | 189 | 2.8 | 3.6 | 2.2 | 3.5 | Mitochondrial precursor, aconitate hydratase | |
| HNOs96 | 191 | 12.7 | 11.1 | 9.9 | 12.3 | Sucrose synthase | oa3.1 |
| HNOs97 | 193 | 4.9 | 2.9 | 2.9 | 3.1 | Chloroplast, putative ketol-acid reductoisomerase | |
| HNOs98 | 195 | 3.7 | 3.6 | 2.5 | 2.6 | N-carbamyl-L-amino acid amidohydrolase | |

*Genes predicted to be within an OA QTL interval.
Note:
the Probes In Bold Were Unique To The High OA Lines.

correspond to the QTL intervals (n=3,954), very few had the at least two-fold change in expression from high OA or low OA lines that suggests critical roles leading to the phenotypic variation (Table 5).

TABLE 5

Description of QTL Intervals and Corresponding ORFs and Number of Two-fold Differentially Regulated Genes

| | QTLs | | | | |
|---|---|---|---|---|---|
| | oa1.1 | oa2.1 | oa3.1 | oa8.1 | oa9.1 |
| Interval | RG104-RG109 (RG811) | RM263-R3393 | EM17_1 (RGP)-CDO20 | R1394A-G2132 | RZ698-RZ792 |
| Genetic distance (cM) | | | | | |
| RGP* | 40.7 | 45.6 | 28.7 | 26.5 | 68.5 |
| IR62266/CT9993† | 5.0 | 13.0 | 5.0 | 5.0 | 4.0 |
| Physical distance (Mbp) | 7.0 | 7.4 | 6.6 | 6.5 | 14.0 |
| Predicted ORFs (#) | 1200 | 891 | 1126 | 924 | 1636 |
| GeneChip probes (#) | 729 | 619 | 588 | 788 | 1148 |
| Accession(s) | | | | | |
| HOA Lines | WW to MDS | | | | |
| induced | 6 | 2 | 8 | 4 | 7 |
| repressed | 3 | 1 | 2 | 2 | 1 |
| | WW to SDS | | | | |
| induced | 1 | 1 | 6 | 1 | 4 |
| repressed | 4 | 1 | 3 | 1 | 2 |
| LOA Lines | WW to MDS | | | | |
| induced | 0 | 0 | 0 | 0 | 0 |
| repressed | 0 | 1 | 0 | 0 | 0 |
| | WW to SDS | | | | |
| induced | 0 | 0 | 0 | 0 | 0 |
| repressed | 0 | 0 | 0 | 0 | 0 |
| IR62266 | WW to MDS | | | | |
| induced | 0 | 0 | 12 | 7 | 12 |
| repressed | 0 | 0 | 3 | 2 | 1 |
| | WW to SDS | | | | |
| induced | 14 | 8 | 15 | 7 | 24 |
| repressed | 8 | 6 | 6 | 3 | 3 |
| CT9993 | WW to MDS | | | | |
| induced | 0 | 1 | 2 | 0 | 1 |
| repressed | 1 | 3 | 1 | 1 | 0 |
| | WW to SDS | | | | |
| induced | 0 | 0 | 0 | 0 | 0 |
| repressed | 0 | 0 | 0 | 0 | 0 |

*Rice Genome Research Program of Japan
†Zhang et al., 2001
WW - well watered;
MDS - moderate dehydration stress;
SDS - severe dehydration stress Twelve of the genes in the OA QTLs were upregulated in all of the high OA lines: aldehyde dehydrogenase, cysteine protease, two heat shock polypeptides, a LEA polypeptide, lipid transferase, phosphatidic acid phosphatase, a pore polypeptide, a ribosomal polypeptide, sucrose synthase, and two unknowns (Table 6). One of the unknown polypeptides, found in oa2.1, is among the genes up regulated in all the high OA lines only. Based on the expression pattern and gene annotations, several candidates were identified for each QTL, including a GTP-binding polypeptide, two homeodomain transcription factors, a trans-acting transcriptional polypeptide, a eukaryotic cap-binding polypeptide, a polypeptide phosphatase 2C, and a mRNA cleavage factor subunit-like polypeptide (Table 6).

TABLE 6

Transcripts with Two-fold Change in Gene Expression among
the Predicted ORFs in the Osmotic Adjustment QTL Intervals

| QTL | Probe Set | SEQ ID No. | Accession | Fold change from WW to MDS | SDS | ID and similarity |
|---|---|---|---|---|---|---|
| oa2.1 | HNOs78 | 155 | IR62266 | 2.12 | 3.09 | GENBANK ® Accession No. P28284: |
|  |  |  | HOADHs | 2.04 | 2.56 | transcriptional protein ICP0 (VMW118 |
|  |  |  | HOADH02 | n.d. | 2.29 | protein); putative retroelement |
|  |  |  | HOADH65 | 2.11 | 2.58 |  |
|  |  |  | HOADH98 | nd | 2.80 |  |
| oa3.1 | HNOs47 | 93 | IR62266 | 2.29 | 2.76 | GENBANK ® Accession No. CAB86075.1: |
|  |  |  | HOADHs | 1.34 | 3.09 | putative protein from *Arabidopsis* |
|  |  |  | HOADH02 | n.d. | 2.34 | *thaliana* |
|  |  |  | HOADH65 | 1.46 | 3.36 |  |
|  |  |  | HOADH98 | n.d. | 3.58 |  |
|  |  |  | LOADH47 | −1.12 | 2.46 |  |

WW - well watered;
MDS - moderate dehydration stress;
SDS - severe dehydration stress;

Example 8

Relationship Between the Transcriptome and the Proteome

In a similar experiment, fourteen polypeptides with differences in abundance in dehydration stressed CT9993 and IR62266 were identified by proteomic analysis (Salekdeh et al., 2002). Eleven of the corresponding genes had complementary probes on the rice GENECHIP® microarray. Two of the corresponding genes, GSH-dependent dehydroascorbate reductase (OS021066_at) and chloroplast superoxide dismutase (Cu—Zn) (OS000704.1_at) were induced in all the osmotic adjusting accessions (see Table 4). An actin-depolymerizing factor polypeptide from rape (GENBANK® Accession No. S30934) was very highly expressed in IR62266 and several DHs during dehydration stress and also in cv. Nipponbare leaves and roots when plants were treated with abscisic acid (ABA), wounding, salt, drought, or cold stress.

It was possible to predict from the rice genomic and cDNA sequences full-length rice gene sequences for all fourteen polypeptides identified. One of the 14 polypeptides identified is found in an OA QTL interval: the rice S-like RNase homologue (GENBANK® Accession No. AY061961) maps to the oa9.1 locus. That gene did not exhibit a two-fold change in gene expression in either parent.

Discussion of Examples 4-8

Plants respond differently from each other to dehydration stress. A moderate level of dehydration stress might have a rather dramatic deleterious effect on the yield of a particular rice cultivar, while a genetically distinct cultivar might suffer no deleterious effects. Susceptibility might invoke a small loss in yield or grain quality, or might possibly lead to total crop loss and economic hardship. Tolerance is sometimes a trait acquired by sensing dehydration and responding in turn with altered gene expression and metabolism. As described herein, large-scale changes in gene expression of two rice accessions and their progeny were measured in response to dehydration stress. Approximately 5% of the genome surveyed exhibited at least a two-fold change in gene transcription. Three hundred and fifty six of the approximately 7000 genes studied were induced and/or repressed under different conditions.

One of the unique aspects of the presently disclosed subject matter is the analysis of two phenotypically divergent rice accessions: IR62266 and CT9993. While combined, about 5% of the genome was differentially expressed in response to dehydration stress, the two accessions had a very different transcript profile. For example, from well watered to SDS, over 65-fold more genes were upregulated in IR62266 than in CT9993. The transcription profile of these two rice accessions in response to salinity, one considered sensitive while the other tolerant to saline conditions, was similar, but the susceptible accession exhibited a much slower response over time (Kawasaki et al., 2001).

On the contrary, the low OA parent, CT9993, had far fewer changes in gene expression and had a very different response than did IR62266. Thus, there was a difference in both the magnitude and the nature of the response to dehydration stress. It is as if the low OA parent has no transcriptional response at all to dehydration, implying the absence of an environment sensing mechanism or failure to initiate the signal transduction that leads to an osmotic adjustment.

The metabolic changes that occur in plants in response to dehydration stress are described in several reviews (e.g., Zhu, 2002; Bray, 2002; Ramanjulu and Bartels, 2002; each herein incorporated by reference). As described herein, changes in gene transcription were measured that suggested that several genes classified as having a photosynthetic or chloroplast organization role were downregulated, and no genes with those predicted functions were upregulated. Genes with cell wall biogenesis and development function were also downregulated. While applicants do not wish to be bound by any particular theory of operation, these results support the notion that dehydration stressed plants are physiologically challenged by dehydration and loss of turgor (reviewed by Zhu, 2002).

There was extensive upregulation of genes predicted to encode antioxidants. Of the genes induced in all high OA lines, several appear to have a role in antioxidant defense mechanisms: three superoxide dismutases, three oxalate oxidases, and two dehydroascorbate reductases. Many other genes were upregulated that are believed to play a role in maintaining cell structure and water potential such as LEA proteins, dehydrin rab, lipid transferases, ferritin, sucrose synthase, and heat shock proteins. Transcriptional activation was also prominently represented in the list of genes upregulated in all high OA lines, such as polyadenylated-binding proteins and a PP2A regulatory subunit. Many of the genes identified herein are predictably regulated in response to dehydration stress.

Quantitative trait loci are in large part a manifestation of DNA sequence polymorphisms associated with altered gene expression (Wang et al., 1999; Cong et al., 2002) or that encode dysfunctional proteins (Yano et al., 2000; El-Assal et al., 2001). Certain types of QTLs are theoretically detectable using large-scale expression analysis. The fw2.2 allele causing large fruit size in tomato reaches peak levels of expression one week later than plants carrying the small-fruited allele (Cong et al., 2002). At a locus controlling apical dominance in maize, the maize allele of teosinte branched1 is expressed at much higher levels than the teosinte allele (Wang et al., 1999). The sequence polymorphism for both genes, fw2.2 and teosinte branched1, are a result of differential regulation caused by sequence polymorphism in non-coding regions of the gene. Several other examples of cloned QTLs have revealed phenotypic variation caused by posttranscriptional variation (Fridman et al., 2000; El-Assal et al., 2001; Maloof et al., 2001). The allelic variants of the Hd1 locus in rice, which is a major QTL controlling response to photoperiod, are expressed at similar levels. The functional difference between the alleles is a 43 base pair deletion in the coding region resulting in increased photoperiod sensitivity (Yano et al., 2000).

Detecting short sequence polymorphisms, for example, down to a single base pair such as those found at the CRY2 and PHYA loci that result in variable light sensitivity and flowering time, requires the use of highly stringent hybridization conditions and that the polymorphic region of the gene is present on the array (El-Assal et al., 2001; Maloof et al., 2001). These types of sequence polymorphisms have been detected in yeast and *Arabidopsis* by hybridizing genomic DNA to an RNA expression GENECHIP® microarray (Winzeler et al., 1998; Borevitz et al., 2003). This approach was used to fine map and clone a high temperature growth QTL in yeast (Steinmetz et al., 2002). Hybridization of RNA from recombinant genetic material has also successfully identified a QTL affecting glucose and fatty acid metabolism in rats (Aitman et al., 1999). The 3' untranslated region (UTR) of a cDNA on a glass slide microarray was found to differentially hybridize between spontaneously hypersensitive rats and normal and congenic strains with a normal Cd36 region introgressed. Similar to this study, the combined use of mouse congenic strains and gene expression profiling to derive several candidates for multiple QTLs (Eaves et al., 2002).

Through expression analysis of divergent and segregating lines and scanning DNA sequence within the OA QTL intervals (Zhang et al., 2001), several genes were identified. Two transcription factors found in the oa2.1 locus were expressed at very high levels in high OA lines and not in low OA lines. The first (OS012941_at) shares similarity to a herpes virus trans-acting transcriptional protein ICP0 and a putative rice retro element. A gene that encodes a homeodomain leucine zipper (OS002156_f_at) is found in the same interval and is induced in all OA lines at MDS. An *Arabidopsis* cap binding protein was recently implicated in the modulation of the ABA response pathway (Hugouvieux et al., 2001).

The oa3.1 interval contains a gene that encodes a eukaryotic cap-binding protein (OS012616.1_at) that is induced in three of the four high OA lines and possibly plays a role in the OA response. A gene for a protein phosphatase 2C (OS012021_at) at the oa8.1 locus is induced in both low and high OA lines and is therefore not a likely candidate for the QTL. However, protein phosphatase 2Cs have been implicated in several instances as being involved in signal transduction related to the abiotic stress response. See e.g., Meyer et al., 1994; Miyazaki et al., 1999.

Another candidate for involvement in a transcriptional response to dehydration stress at that locus is a gene similar to an mRNA cleavage factor subunit-like protein (OS014496.1_at). Two regulatory elements found at oa9.1 were induced in high OA lines: an HD-Zip transcription factor (OS021591_f_at) and a pathogenesis related protein with putative negative regulatory element binding properties (OS000514_at).

Allelic variation at these loci might be a factor in the genetic cause of the phenotypic differences measured between low and high OA lines. It is also possible that the allelic variation was not detected using the oligo array because either expression was not measured when the causal differences were apparent or the variation is not a product of a difference in gene expression. However, these sequences co-segregate with the OA phenotype, have annotations that suggests an active role, and have expression profiles that further suggest their involvement in dehydration stress.

Example 9

Expression Vectors and Transformation of Plants

Binary destination vectors for plant transformation comprise or optionally consist of a binary backbone and a T-DNA portion. The binary backbone contains the sequences necessary for selection and growth in *Escherichia coli* DH-5α (Invitrogen Corp., Carlsbad, Calif., United States of America) and *Agrobacterium tumefaciens* LBA4404, including the bacterial spectinomycin antibiotic resistance aadA gene from *E. coli* transposon Tn7, origins of replication for *E. coli* (ColE1) and *A. tumefaciens* (VS1), and the *A. tumefaciens* virG gene. The T-DNA portion is flanked by the right and left border sequences and includes the POSITECH™ (Syngenta Corp., Wilmington, Del., United States of America) plant selectable marker and a gene expression cassette that varies depending on the application. The POSITECH™ plant selectable marker in this instance consists of a rice actin (ACT1) promoter driving expression of the phosphomannose isomerase (PMI) gene followed by the cauliflower mosaic virus transcriptional terminator, which confers resistance to mannose.

The gene expression cassette portion of binary destination vectors varies depending on the application. In general, the cassette comprises and optionally consists of a promoter designed to express the gene of interest in certain tissues of the plant, followed by cloning sites (in some cases interrupted by a segment of spacer DNA), and finally by the *A. tumefaciens* nos 3' end transcriptional terminator. The promoters used are designed to express the gene of interest in specific target tissues. For example, endosperm expression can be obtained using a promoter from the rice RS-4, wheat glutelin, maize ADPgpp or γ-zein, or barley α-thionin gene, embryo expression can be obtained using a promoter from the maize globulin or oleosin gene; aleurone expression can be obtained using a promoter from the barley α-amylase gene; root expression can be obtained using a promoter from the maize MSR1 or MRS3 gene; and green tissue expression can be obtained using a promoter from the maize PEPC gene. Constitutive expression can be obtained using a promoter from, for example, the maize UBI gene plus intron, depending on the gene of interest. The cloning site contains either unique restriction enzyme sites (for conventional cloning) and/or a GATEWAY™ recombination-based cloning cassette (Invitrogen Corp., Carlsbad, Calif., United States of America), in either the forward or reverse orientation.

In gene expression cassettes designed for double-stranded interfering RNA (dsRNA) production, the cloning site is divided by a spacer region (e.g. first intron of the rice SH1 gene). The spacer permits the cloning of two gene fragments: one in the forward orientation and one in the reverse orientation. Antisense (reverse orientation expression) is another technology available for silencing genes of interest.

Transformation of the nucleic acid molecules of the presently disclosed subject matter into plants is performed using the methods disclosed herein above.

REFERENCES

The references listed below as well as all references cited in the specification are incorporated herein by reference to the extent that they supplement, explain, provide a background for or teach methodology, techniques, and/or compositions employed herein.

Aitman T J, Glazier A M, Wallace C A, Cooper L D, Norsworthy P J, Wahid F N, Al Majali K M, Trembling P M, Mann C J, Shoulders C C, Graf D, St Lezin E, Kurtz T W, Kren V, Pravenec M, Ibrahimi A, Abumrad N A, Stanton L W & Scott J (1999). Identification of Cd36 (Fat) as an insulin-resistance gene causing defective fatty acid and glucose metabolism in hypertensive rats. *Nat Genet* 21:76-83.

Allison R F, Johnston R E & Dougherty W G (1986) The nucleotide sequence of the coding region of tobacco etch virus genomic RNA: evidence for the synthesis of a single polyprotein. *Virology* 154:9-20.

Altschul S F, Gish W, Miller W, Myers E W & Lipman D J (1990) Basic Local Alignment Search Tool. *J Mol Biol* 215:403-410.

Aoyama T & Chua N-H (1997) A glucocorticoid-mediated transcriptional induction system in transgenic plants. *Plant J* 11:605-612.

Ausubel F M, Brent R, Kingston R E, Moore D D, Seidman J G, Smith J A & Struhl K (2002) *Short Protocols in Molecular Biology*, Fifth ed. Wiley, New York, N.Y., United States of America.

Ausubel F M, Brent R, Kingston R E, Moore D D, Seidman J G, Smith J A & Struhl K (2003) *Current Protocols in Molecular Biology*, John Wylie & Sons, Inc., New York, N.Y., United States of America.

Barany G & Merrifield R B (1980) Solid-Phase Peptide Synthesis, in *Peptides: Analysis, Synthesis, Biology, Vol. 2, Special Methods in Peptide Synthesis, Part A* (Gross E & Meienhofer J, eds) Academic Press, New York, N.Y., United States of America, pp. 3-284.

Bartlett S G, Grossman A R & Chua N-H (1982) in *Methods in Chloroplast Molecular Biology*, (Edelman M, Hallick R B & Chua N-H, eds.) Elsevier Biomedical Press, New York, N.Y., United States of America, pp. 1081-1091.

Batzer M A, Carlton J E & Deininger P L (1991) Enhanced evolutionary PCR using oligonucleotides with inosine at the 3'-terminus. *Nucleic Acid Res.* 19:5081.

Beerli R R, Segal D J, Dreier B & Barbas C F 3rd. (1998) Toward controlling gene expression at will: specific regulation of the erbB-2/HER-2 promoter by using polydactyl zinc finger proteins constructed from modular building blocks. *Proc Natl Acad Sci USA* 95:14628-14633.

Bevan M (1984) Binary *Agrobacterium* vectors for plant transformation. *Nucl. Acids Res* 12:8711-21.

Bevan M, Flavell R B & Chilton M D (1983) A chimeric antibiotic resistance gene as a selectable marker for plant cell transformation. *Nature* 304:184-187.

Binet M N Weil J H & Tessier L H (1991) Structure and expression of sunflower ubiquitin genes. *Plant Mol Biol* 17:395-407.

Blochinger K & Diggelmann H (1984) Hygromycin B phosphotransferase as a selectable marker for DNA transfer experiments with higher eukaryotic cells. *Mol Cell Biol* 4:2929-2931.

Borevitz J O, Liang D, Plouffe D, Chang H S, Zhu T, Weigel D, Berry C C, Winzeler E & Chory J (2003). Large-scale identification of single feature polymorphisms in complex genomes. *Genome Res* 13:513-523.

Bourouis M & Jarry B (1983) Vectors containing a prokaryotic dihydrofolate reductase gene transform *Drosophila* cells to methotrexate-resistance. *EMBO J.* 2:1099-1104.

Bray E A (2002). Classification of genes differentially expressed during water-deficit stress in *Arabidopsis thaliana*: an analysis using Microarray and differential expression data. *Ann Bot* 89:803-811.

Bruggemann E, Handwerger K, Essex C & Storz G (1996) Analysis of fast neutron-generated mutants at the *Arabidopsis thaliana* HY4 locus. *Plant J* 10:755-760.

Caddick M X, Greenland A J, Jepson I, Krause K P, Qu N, Riddell K V, Salter M G, Schuch W, Sonnewald U & Tomsett A B. (1998) An ethanol inducible gene switch for plants used to manipulate carbon metabolism. *Nat Biotechnol* 16:177-180.

Callis J, Fromm M & Walbot V (1987) Introns increase gene expression in cultured maize cells. *Genes Dev.* 1:1183-1200.

Callis J, Raasch J A & Vierstra R D (1990) Ubiquitin extension proteins of *Arabidopsis thaliana*. Structure, localization, and expression of their promoters in transgenic tobacco. *J Biol Chem* 265:12486-12493.

Chibbar R N, Kartha K K, Datla R S S, Leung N, Caswell K, Mallard C S & Steinhauer L (1993) The effect of different promoter-sequences on transient expression of gus reporter gene in cultured barley (*Hordeum vulgare* L.) cells. *Plant Cell Rep* 12:506-509.

Christensen A H & Quail P H (1989) Sequence analysis and transcriptional regulation by heat shock of polyubiquitin transcripts from maize. *Plant Mol Biol* 12:619-632.

Christou P, Ford T & Kofron M (1991) Production of transgenic rice (*Oryza sativa* L.) plants from agronomically important indica and japonica varieties via electric discharge particle acceleration of exogenous DNA into immature zygotic embryos. *Bio/Technology* 9: 957-962.

Chuang C F & Meyerowitz E M (2000) Specific and heritable genetic interference by double-stranded RNA in *Arabidopsis thaliana*. *Proc Natl Acad Sci USA* 97:4985-90.

Clark M S (ed.) (1997) *Plant Molecular Biology: A Laboratory Manual*, Chapter 7, Springer-Verlag GmbH & Co. KG, Berlin, Germany.

Comai L, Larson-Kelly N, Kiser J, Mau C J, Pokalsky A R, Shewmaker C K, McBride K, Jones A & Stalker D M (1988) Chloroplast transport of a ribulose bisphosphate carboxylase small subunit-5-enolpyruvyl 3-phosphoshikimate synthase chimeric protein requires part of the mature small subunit in addition to the transit peptide. *J Biol Chem* 263:15104-15109.

Cong B, Liu J P & Tanksley S D (2002). Natural alleles at a tomato fruit size quantitative trait locus differ by heterochronic regulatory mutations. *Proc Natl Acad Sci USA* 99:13606-13611.

Creighton T E (1984) Proteins, WH Freeman & Co., New York, N.Y., United States of America.

Datta S K, Peterhans A, Datta K & Potrykus I (1990) Genetically engineered fertile Indica-rice recovered from protoplasts. *Bio/Technology* 8:736-740.

de Framond A J (1991) A metallothionein-like gene from maize (*Zea mays*). Cloning and characterization. *FEBS Lett* 290:103-6.

Della-Cioppa G, Kishore G M, Beachy R N & Fraley R T (1987) Protein trafficking in plant cells. *Plant Physiol* 84:965-968.

Deutscher M P, Simon M I & Abelson J N (eds) (1997) Guide to Protein Purification, *Meth Enzymol* Volume 182.

Dong, J J, Teng W M, Buchholz W G & Hall T C (1996). *Agrobacterium*-mediated transformation of javanica rice. *Mol Breeding* 2:267-276.

Eaves I A, Wicker L S, Ghandour G, Lyons P A, Peterson L B, Todd J A & Glynne R J (2002). Combining mouse congenic strains and microarray gene expression analyses to study a complex trait: The NOD model of type 1 diabetes. *Genome Res* 12:232-243.

Ecker J R & Davis R W (1986) Inhibition of Gene Expression in Plant Cells by Expression of Antisense RNA. *Proc Natl Acad Sci USA* 83:5372-5376.

El-Assal S E D, Alonso-Blanco C, Peeters A J M, Raz V & Koornneef M (2001). A QTL for flowering time in *Arabidopsis* reveals a novel allele of CRY2. *Nat Genet* 29:435-440.

Elroy-Stein O, Fuerst T R & Moss B (1989) Cap-Independent Translation of mRNA Conferred by Encephalomyocarditis Virus 5' Sequence Improves the Performance of the Vaccinia Virus/Bacteriophage T7 Hybrid Expression System. *Proc Nat Acad Sci USA* 86:6126-6130.

EP 0 292 435
EP 0 332 104
EP 0 332 581
EP 0 342 926
EP 0 359 472
EP 0 385 962
EP 0 392 225

Firek S, Draper J, Owen M R, Gandecha A, Cockburn B & Whitelam G C (1993) Secretion of a functional single-chain Fv protein in transgenic tobacco plants and cell suspension cultures. *Plant Mol Biol* 22:129-142.

Fridman E, Pleban T & Zamir D (2000). A recombination hotspot delimits a wild-species quantitative trait locus for tomato sugar content to 484 bp within an invertase gene. *Proc Natl Acad Sci USA* 97:4718-4723.

Fromm M E, Morrish F, Armstrong C, Williams R, Thomas J & Klein T M. (1990) Inheritance and expression of chimeric genes in the progeny of transgenic maize plants. *Biotechnology (NY)* 8:833-839.

Gaffney T, Friedrich L, Vernooij B, Negrotto D, Nye G, Uknes S, Ward E, Kessmann H & Ryals J (1993) Requirement of Salicylic Acid for the Induction of Systemic Acquired Resistance. *Science* 261:754-756.

Gallie D R, Sleat D E, Watts J W, Turner P C & Wilson T M (1987) A comparison of eukaryotic viral 5'-leader sequences as enhancers of mRNA expression in vivo. *Nucl Acids Res* 15:8693-8711.

Gallie D R et al. (1989) in *Molecular Biology of RNA* (Cech T R, ed.), Alan R. Liss, Inc., New York, N.Y., United States of America, pp. 237-256.

Goff S A, Ricke D, Lan T H, Presting G, Wang R L, Dunn M, Glazebrook J, Sessions A, Oeller P, Varma H, Hadley D, Hutchinson D, Martin C, Katagiri F, Lange B M, Moughamer T, Xia Y, Budworth P, Zhong J P, Miguel T, Paszkowski U, Zhang S P, Colbert M, Sun W L, Chen L L, Cooper B, Park S, Wood T C, Mao L, Quail P, Wing R, Dean R, Yu Y S, Zharkikh A, Shen R, Sahasrabudhe S, Thomas A, Cannings R, Gutin A, Pruss D, Reid J, Tavtigian S, Mitchell J, Eldredge G, Scholl T, Miller R M, Bhatnagar S, Adey N, Rubano T, Tusneem N, Robinson R, Feldhaus J, Macalma T, Oliphant A & Briggs, S (2002) A draft sequence of the rice genome (*Oryza sativa* L ssp *japonica*). *Science* 296:92-100.

Gordon-Kamm W J, Spencer T M, Mangano M L, Adams T R, Daines R J, Start W G, O'Brien J V, Chambers S A, Adams W R Jr., Willetts N G, Rice T B, Mackey C J, Krueger R W, Kausch A P & Lemaux P G (1990) Transformation of Maize Cells and Regeneration of Fertile Transgenic Plants. *Plant Cell* 2:603-618.

Green M R (2000) TBP-associated factors (TAFIIs): multiple, selective transcriptional mediators in common complexes. *Trends Biochem Sci* 25:59-63.

Green P J, Pines O & Inouye M (1986) The role of antisense RNA in gene regulation. *Ann Rev Biochem* 55:569-597.

Gritz L & Davies J (1983) Plasmid-encoded hygromycin B resistance: the sequence of hygromycin B phosphotransferase gene and its expression in *Escherichia coli* and *Saccharomyces cerevisiae*. *Gene* 25:179-188.

Harlow E & Lane D (1988) *Antibodies: A Laboratory Manual*, Cold Spring Harbor Laboratory Press, Cold Spring Harbor, N.Y., United States of America.

Henikoff S & Henikoff J G (1992) Amino Acid Substitution Matrices from Protein Blocks. *Proc Natl Acad Sci USA* 89:10915-10919.

Hiei Y, Komari T & Kubo T (1997) Transformation of rice mediated by *Agrobacterium tumefaciens*. *Plant Mol Biol* 35:205-18.

Hiei Y, Ohta S, Komari T & Kumashiro Y (1994) Efficient transformation of rice (*Oryza sativa* L.) mediated by *Agrobacterium* and sequence analysis of the boundaries of the T-DNA. *Plant J* 6(2):271-282.

Höfgen R & Willmitzer L (1988) Storage of competent cells for *Agrobacterium* transformation. *Nucl Acids Res* 16:9877.

Hudspeth R L & Grula J W (1989) Structure and expression of the maize gene encoding the phosphoenolpyruvate carboxylase isozyme involved in C4 photosynthesis. *Plant Molec Biol* 12:579-589.

Hugouvieux V, Kwak J M & Schroeder J I (2001). An mRNA cap binding protein, ABH1, modulates early abscisic acid signal transduction in *Arabidopsis*. *Cell* 106:477-487.

Jobling S A & Gehrke L (1987) Enhanced translation of chimaeric messenger RNAs containing a plant viral untranslated leader sequence. *Nature* 325:622-625.

Jorgensen R A, Cluster P D, English J, Que Q & Napoli C A (1996) Chalcone synthase cosuppression phenotypes in petunia flowers: comparison of sense vs. antisense constructs and single-copy vs. complex T-DNA sequences. *Plant Mol Biol* 31:957-973.

Joshi C P (1987) An inspection of the domain between putative TATA box and translation start site in 79 plant genes. *Nucleic Acids Res* 15:6643-6653.

Karlin S & Altschul S F (1993) Applications and Statistics for Multiple High-Scoring Segments in Molecular Sequences. *Proc Natl Acad Sci USA* 90:5873-5877.

Kawasaki S, Borchert C, Deyholos M, Wang H, Brazille S, Kawai K, Galbraith D & Bohnert H J (2001). Gene expression profiles during the initial phase of salt stress in rice. *Plant Cell* 13:889-905.

Keegan L, Gill G & Ptashne M (1986) Separation of DNA binding from the transcription-activating function of a eukaryotic regulatory protein. *Science* 231:699-704.

Kempin S A, Liljegren S J, Block L M, Rounsley S D, Yanofsky M F & Lam E (1997) Targeted disruption in *Arabidopsis*. *Nature* 389:802-803.

Klein T M, Wolf E D, Wu R & Sanford J C (1987) High velocity microprojectiles for delivering nucleic acids into living cells. *Nature* 327:70-73.

Koehler S M & Ho T M (1990) Hormonal regulation, processing, and secretion of cysteine proteinases in barley aleurone layers. *Plant Cell* 2:769-783.

Kong P & Steinbiss H H (1998) Complete nucleotide sequence and analysis of the putative polyprotein of maize dwarf mosaic virus genomic RNA (Bulgarian isolate). *Arch Virol* 143:1791-1799.

Koziel M G, Beland G L, Bowman C, Carozzi N B, Crenshaw R, Crossland L, Dawson J, Desai N, Hill M, Kadwell S, Launis L, Lewis K, Maddox D, McPherson K, Meghji M R, Merlin E, Rhodes R, Warren G W, Wright M & Evola S V (1993) Field performance of elite transgenic maize plants expressing an insecticidal protein derived from *Bacillus thuringiensis*. *Bio/Technology* 11:194-200.

Kreps J A, Wu Y J, Chang H S, Zhu T, Wang X & Harper J F (2002). Transcriptome changes for *Arabidopsis* in response to salt, osmotic, and cold stress. *Plant Physiol* 130:2129-2141.

Kuchler R J (1997) *Biochemical Methods in Cell Culture and Virology*, Dowden, Hutchinson and Ross, Inc., Stroudsburg, Pa., United States of America Kyte J & Doolittle R F (1982) A Simple Method for Displaying the Hydropathic Character of a Protein. *J Mol Biol* 157:105-132.

Lebel E, Heifetz P, Thorne L, Uknes S, Ryals J & Ward E (1998) Functional analysis of regulatory sequences controlling PR-1 gene expression in *Arabidopsis*. *Plant J* 16:223-233.

Liu L X, Spoerke J M, Mulligan E L, Chen J, Reardon B, Westlund B, Sun L, Abel K, Armstrong B, Hardiman G, King J, McCague L, Basson M, Clover R & Johnson C D (1999) High-throughput isolation of *Caenorhabditis elegans* deletion mutants. *Genome Res* 9:859-867.

Logemann J, Lipphardt S, Lorz H, Hauser I, Willmitzer L & Schell J (1989) 5' upstream sequences from the wun1 gene are responsible for gene activation by wounding in transgenic plants. *Plant Cell* 1:151-158.

Lommel S A, Kendall T L, Xiong Z & Nutter R C (1991) Identification of the maize chlorotic mottle virus capsid protein cistron and characterization of its subgenomic messenger RNA. *Virology* 81:382-385.

Macejak D G & Sarnow P (1991) Internal initiation of translation mediated by the 5' leader of a cellular mRNA. *Nature* 353:90-94.

Maloof J N, Borevitz J O, Dabi T, Lutes J, Nehring R B, Redfern J L, Trainer G T, Wilson J M, Asami T, Berry C C, Weigel D & Chory J (2001). Natural variation in light sensitivity of *Arabidopsis*. *Nat Genet* 29:441-446.

Martienssen R A (1998) Functional genomics: probing plant gene function and expression with transposons. *Proc Natl Acad Sci USA* 95:2021-2026.

Mayo O (1987) *The Theory of Plant Breeding*, Second Edition, Clarendon Press, New York, N.Y., United States of America.

McBride K E & Summerfelt K R (1990) Improved binary vectors for *Agrobacterium*-mediated plant transformation. *Plant Mol Biol* 14: 269-276.

McBride K E, Schaaf D J, Daley M & Stalker D M (1994) Controlled expression of plastid transgenes in plants based on a nuclear DNA-encoded and plastid-targeted T7 RNA polymerase. *Proc Natl Acad Sci USA* 91:7301-7305.

McElroy D, Blowers A D, Jenes B & Wu R (1991) Construction of expression vectors based on the rice actin 1 (Act1) 5' region for use in monocot transformation. *Mol. Gen. Genet.* 231:150-160.

McElroy D, Zhang W, Cao J & Wu R (1990) Isolation of an efficient actin promoter for use in rice transformation. *Plant Cell* 2:163-71.

Merrifield R B (1963) Solid Phase Peptide Synthesis. I. The Synthesis of a Tetrapeptide *J. Am. Chem. Soc.* 85:2149-54.

Messing J & Vieira J (1982) A new pair of M13 vectors for selecting either DNA strand of double-digest restriction fragments. *Gene* 19:259-268.

Mettler I J (1987) A simple and rapid method for miniprepration of DNA from tissue-cultured plant cells *Plant Mol Biol Reporter* 5:346-349.

Meyer K, Leube M P & Grill E (1994). A protein phosphatase 2C involved in ABA signal-transduction in *Arabidopsis thaliana*. *Science* 264:1452-1455.

Miao Z H & Lam E (1995) Targeted disruption of the TGA3 locus in *Arabidopsis thaliana*. *Plant J* 7:359-365.

Miyazaki S, Koga R, Bohnert H J & Fukuhara T (1999). Tissue- and environmental response-specific expression of 10 PP2C transcripts in *Mesembryanthemum crystallinum*. *Mol Gen Genet* 261:307-316.

Mukumoto F, Hirose S, Imaseki H & Yamazaki K (1993) DNA sequence requirement of a TATA element-binding protein from *Arabidopsis* for transcription in vitro. *Plant Mol Biol* 23: 995-1003.

Murashige T & Skoog F (1962) A revised medium for rapid growth and bioassays with tobacco tissue culture. *Physiologia Plantarum* 15: 473-497 (1962)

Needleman S B & Wunsch C D (1970) A General Method Applicable to the Search for Similarities in the Amino Acid Sequence of Two proteins. *J Mol Biol* 48:443-453.

Negrotto D, Jolley M, Beer S, Wenck A R & Hansen G (2000) The use of phosphomannose-isomerase as a selection marker to recover transgenic maize plant (*Zea may* L.) via *Agrobacterium* transformation. *Plant Cell Reports* 19:798-803.

Norris S R, Meyer S E & Callis J (1993) The intron of *Arabidopsis thaliana* polyubiquitin genes is conserved in location and is a quantitative determinant of chimeric gene expression. *Plant Mol Biol* 21:895-906.

Ohtsuka E, Matsuki S, Ikehara M, Takahashi Y & Matsubara K (1985) An alternative approach to deoxyoligonucleotides as hybridization probes by insertion of deoxyinosine at ambiguous codon positions. *J. Biol. Chem.* 260:2605-2608.

Ozturk Z N, Talame V, Deyholos M, Michalowski C B, Galbraith D W, Gozukirmizi N, Tuberosa R & Bohnert H J (2002). Monitoring largescale changes in transcript abundance in drought- and salt-stressed barley. *Plant Mol. Biol* 48:551-573.

Paszkowski J, Bauer M, Bogucki A & Potrykus I (1988) Gene targeting in plants. *EMBO J.* 7:4021-26.

Paszkowski J, Shillito R D, Saul M, Mandak V, Hohn T, Hohn B & Potrykus I (1984) Direct gene transfer to plants. *EMBO J.* 3:2717-2722.

Paterson A H (1996) The DNA Revolution, chapter 2 in *Genome Mapping in Plants*, Paterson A H (ed), Academic Press/R.G. Lands Co., Austin, Tex., United States of America.

PCT International Publication WO 93/07278
PCT International Publication WO 93/21335
PCT International Publication WO 94/00977
PCT International Publication WO 95/19431
PCT International Publication WO 96/06166
PCT International Publication WO 97/32011
PCT International Publication WO 98/54311
PCT International Publication WO 99/32619
PCT International Publication WO 99/53050
PCT International Publication WO 99/61631

Pearson W R & Lipman D J (1988) Improved Tools for Biological Sequence Comparison. *Proc Natl Acad Sci USA* 85:2444-2448.

Picard D, Salser S J & Yamamoto K R (1988) A movable and regulable inactivation function within the steroid binding domain of the glucocorticoid receptor. *Cell* 54: 1073-1080.

Potrykus I, Paszkowski J, Saul M W, Petruska J & Shillito R D (1985) Molecular and general genetics of a hybrid foreign gene introduced into tobacco by direct gene transfer. *Mol Gen Genet* 199:169-177.

Powell P A, Stark D M, Sanders P R & Beachy R N (1989) Protection against Tobacco Mosaic Virus in Transgenic Plants that Express Tobacco Mosaic Virus Antisense RNA. *Proc. Natl. Acad. Sci. USA* 86:6949-6952.

Ramanjulu S & Bartels D (2002). Drought- and desiccation-induced modulation of gene expression in plants. *Plant Cell Env* 25:141-151.

Reed J N, Privalle L S, Powell M J, Meghji M, Dawson J, Dunder E M, Suttie J, Wenck A, Launis K, Kramer C, Chang Y, Hansen G & Wright M (2001) Phosphomannose isomerase: An efficient selectable marker for plant transformation. *In Vitro Cell Dev Biol-Plant* 37:127-132.

Redei G P & Koncz C (1992) Classical mutagenesis, in *Methods in Arabidopsis Research* (Koncz C, Chua N-H & Schell J, eds.) World Scientific Press, River Edge, N.J., United States of America, pp. 16-82.

Reich T J, Iyer V N & Miki B L (1986) Efficient transformation of alfalfa protoplasts by the intranuclear microinjection of Ti-plasmids. *Bio/Technology* 4:1001-1004.

Reiter R S, Young R M & Scolnik P A (1992) Genetic Linkage of the *Arabidopsis* Genome: Methods for Mapping with Recombinant Inbreds and Random Amplified Polymorphic DNAs (RAPDs) in *Methods in Arabidopsis Research*, World Scientific Press, River Edge, N.J., United States of America.

Rogers J C, Dean D & Heck G R (1985) Aleurain: a barley thiol protease closely related to mammalian cathepsin H. *Proc. Natl. Acad. Sci. USA* 82:6512-6516.

Rohrmeier T & Lehle L (1993) WIP1, a wound-inducible gene from maize with homology to Bowman-Birk proteinase inhibitors. *Plant Mol Biol* 22:783-792.

Rossolini G M, Cresti S, Ingianni A, Cattani P, Riccio M L & Satta G (1994) Use of deoxyinosine-containing primers vs degenerate primers for polymerase chain reaction based on ambiguous sequence information. *Mol Cell Probes* 8:91-98.

Roth B A, Goff S A, Klein T M & Fromm M E (1991) C1- and R-dependent expression of the maize Bz1 gene requires sequences with homology to mammalian myb and myc binding sites. *Plant Cell* 3:317-325.

Rothstein S J, Lahners K N, Lotstein R J, Carozzi N B, Jayne S M & Rice D A (1987) Promoter cassettes, antibiotic-resistance genes, and vectors for plant transformation. *Gene* 53:153-161.

Salekdeh G H, Siopongco J, Wade L J, Ghareyazie B & Bennett J (2002). Proteomic analysis of rice leaves during drought stress and recovery. *Proteomics* 2:1131-1145.

Sambrook J & Russell D W (2001) *Molecular Cloning: A Laboratory Manual*, 3rd ed. Cold Spring Harbor Laboratory Press, Cold Spring Harbor, N.Y., United States of America.

Schmidhauser T J & Helinski D R (1985) Regions of broad-host-range plasmid RK2 involved in replication and stable maintenance in nine species of gram-negative bacteria. *J Bacteriol* 164:446-455.

Schocher R J, Shillito R D, Saul M W, Paszkowski J & Potrykus I (1986) Co-transformation of foreign genes into plants. *Bio/Technology* 4:1093-1096.

Schoof H, Ernst R, Nazarov V, Pfeifer L, Mewes H W & Mayer K F (2004) MIPS *Arabidopsis thaliana* Database (MAtDB): an integrated biological knowledge resource for plant genomics. *Nucleic Acids Res* 32 (Database issue): D373-6.

Schoof H, Zaccaria P, Gundlach H, Lemcke K, Rudd S, Kolesov G, Arnold R, Mewes H W & Mayer K F X (2002). MIPS *Arabidopsis thaliana* Database (MAtDB): an integrated biological knowledge resource based on the first complete plant genome. *Nucleic Acids Res* 30:91-93.

Schultz B et al., (1998) T-DNA tagging in *Arabidopsis thaliana*: Cloning by gene disruption, in *Plant Molecular Biology Manual* ($2^{nd}$ edition, Gelvin S B, Schilperoort R A & Verma D P S, eds.) Kluwer Academic Publishers, New York, N.Y., United States of America.

Scopes R (1982) *Protein Purification: Principles and Practice*, Springer-Verlag, New York, N.Y., United States of America.

Sherman F, Fink G R & Hicks J (1982) *Methods in Yeast Genetics*, Cold Spring Harbor Laboratory Press, Cold Spring Harbor, N.Y., United States of America Shimamoto K, Terada R, Izawa T & Fujimoto H (1989) Fertile transgenic rice plants regenerated from transformed protoplasts. *Nature* 338:274-276.

Shinshi H, Neuhas J M, Ryals J & Meins F Jr. (1990) Structure of a tobacco endochitinase gene: evidence that different chitinase genes can arise by transposition of sequences encoding a cysteine-rich domain. *Plant Mol Biol* 14:357-368.

Silhavy T J, Berman M L & Enquist L W (1984) *Experiments with Gene Fusions*, Cold Spring Harbor Laboratory, Cold Spring Harbor, N.Y., United States of America.

Silverstone A L, Ciampaglio C N & Sun T (1998) The *Arabidopsis* RGA gene encodes a transcriptional regulator repressing the gibberellin signal transduction pathway. *Plant Cell* 10:155-169.

Singh D P (1986) *Breeding for Resistance to Diseases and Insect Pests*, Springer-Verlag, New York, N.Y., United States of America.

Skuzeski J M, Nichols L M & Gesteland R F (1990) Analysis of leaky viral translation termination codons in vivo by transient expression of improved beta-glucuronidase vectors. *Plant Mol Biol* 15:65-79.

Smith N A, Singh S P, Wang M B, Stoutjesdijk P A, Green A G & Waterhouse P M (2000) Total silencing by intron-spliced hairpin RNAs. *Nature* 407:319-320.

Smith T F & Waterman M (1981) Comparison of Biosequences. *Adv Appl Math* 2:482-489.

Southern J A, Young D F, Heaney F, Baumgartner W K, Randall R E (1991) Identification of an epitope on the P and V proteins of simian virus 5 that distinguishes between two isolates with different biological characteristics. *J Gen Virol* 72:1551-7.

Spencer T M, Gordon-Kamm W J, Daines R J, Start W & Lemaux P (1990). *Theor Appl Genet* 79:625-631.

Steinmetz L M, Sinha H, Richards D R, Spiegelman J I, Oefner P J, McCusker J H & Davis R W (2002). Dissecting the architecture of a quantitative trait locus in yeast. *Nature* 416:326-330.

Stewart J M & Young J D (1984) *Solid Phase Peptide Synthesis*, $2^{nd}$ ed. Pierce Chemical Co., Rockford, Ill., United States of America.

Svab Z, Hajdukiewicz P & Maliga P (1990) Stable transformation of plastids in higher plants. *Proc Natl Acad Sci USA* 87:8526-8530.

Svab Z & Maliga P (1993) High-frequency plastid transformation in tobacco by selection for a chimeric aadA gene. *Proc Natl Acad Sci USA* 90:913-917.

Taylor M, Vasil V & Vasil I K (1993) Enhanced gus gene expression in cereal grass cell suspensions and immature embryos using the maize ubiquitin-based plasmid pAHC25. *Plant Cell Rep* 12:491-495.

Thompson C J, Mowa N R, Tizard R, Crameri R, Davies J E, Lauwereys M & Botterman J (1987) Characterization of the herbicide-resistance gene bar from *Streptomyces hygroscopicus*. *EMBO J.* 6:2519-2523.

Tijssen P (1993) *Laboratory Techniques in Biochemistry and Molecular Biology-Hybridization with Nucleic Acid Probes*. Elsevier, New York, N.Y., United States of America.

Trewavas A J (2001) The population/biodiversity paradox. agricultural efficiency to save wilderness. *Plant Physiol.* 125:174-179.

Triezenberg S J, Kingsbury R C & McKnight S L (1988) Functional dissection of VP16, the trans-activator of herpes simplex virus immediate early gene expression. *Genes Dev* 2:718-729.

Uknes S, Dincher S, Friedrich L, Negrotto D, Williams S, Thompson-Taylor H, Potter S, Ward E & Ryals J (1993) Regulation of pathogenesis-related protein-1a gene expression in tobacco. *Plant Cell* 5:159-169.

Uknes S, Mauch-Mani B, Moyer M, Potter S, Williams S, Dincher S, Chandler D, Slusarenko A, Ward E & Ryals J (1992) Acquired resistance in *Arabidopsis. Plant Cell* 4:645-656.

Unger E A, Hand J M, Cashmore A R & Vasconcelos A C (1989) Isolation of a cDNA encoding mitochondrial citrate synthase from *Arabidopsis thaliana. Plant Mol Biol* 13:411-418.

U.S. Pat. No. 4,554,101
U.S. Pat. No. 4,940,935
U.S. Pat. No. 4,945,050
U.S. Pat. No. 4,987,071
U.S. Pat. No. 5,036,006
U.S. Pat. No. 5,100,792
U.S. Pat. No. 5,188,642
U.S. Pat. No. 5,270,163
U.S. Pat. No. 5,466,785
U.S. Pat. No. 5,501,967
U.S. Pat. No. 5,523,311
U.S. Pat. No. 5,591,616
U.S. Pat. No. 5,614,395
U.S. Pat. No. 5,639,949
U.S. Pat. No. 5,767,378
U.S. Pat. No. 5,994,629

Van den Broeck G, Timko M P, Kausch A P, Cashmore A R, Van Montagu M & Herrera-Estrella L (1985) Targeting of a foreign protein to chloroplasts by fusion to the transit peptide from the small subunit of ribulose 1,5-bisphosphate carboxylase. *Nature* 313:358-363.

van der Krol A et al., In: *Antisense nucleic acids and proteins* (Joseph M & van der Krol A, eds.) Marcel Dekker Inc, New York, N.Y., United States of America, pp. 125-141.

Vasil V, Castillo A M, Fromm M E & Vasil I K (1992) Herbicide resistant fertile transgenic wheat plants obtained by microprojectile bombardment of regenerable embryogenic callus. *Bio/Technology* 10:667-674.

Vasil V, Srivastava V, Castillo A M, Fromm M R & Vasil I K (1993) Rapid production of transgenic plants by direct bombardment of cultured immature embryos. *Bio/Technology* 11:1553-1558.

Wang R L, Stec A, Hey J, Lukens L & Doebley J (1999). The limits of selection during maize domestication. *Nature* 398:236-239.

Warner S A, Scott R, Draper J (1993) Isolation of an asparagus intracellular PR gene (AoPR1) wound-responsive promoter by the inverse polymerase chain reaction and its characterization in transgenic tobacco. *Plant J* 3:191-201.

Wasmann C C et al. (1986) *Mol Gen Genet* 205:446-453.

Waterhouse P M, Graham M W & Wang M B (1998) Virus resistance and gene silencing in plants can be induced by simultaneous expression of sense and antisense RNA. *Proc Natl Acad Sci USA* 95:13959-13964.

Weeks J T, Anderson O D & Blechl A E (1993) Rapid Production of Multiple Independent Lines of Fertile Transgenic Wheat (*Triticum aestivum*). *Plant Physiol* 102:1077-1084.

Welsh J R (1981) *Fundamentals of Plant Genetics and Breeding*, John Wiley & Sons, New York, N.Y., United States of America.

White J, Chang S Y & Bibb M J (1990) A cassette containing the bar gene of *Streptomyces hygroscopicus*: a selectable marker for plant transformation. *Nucl Acids Res* 18:1062.

Winkler R G & Feldmann K A (1989) PCR-based identification of T-DNA insertion mutants. *Meth Mol Biol* 82:129-136.

Winzeler E A, Richards D R, Conway A R, Goldstein A L, Kalman S, McCullough M J, McCusker J H, Stevens D A, Wodicka L, Lockhart D J & Davis R W (1998). Direct allelic variation scanning of the yeast genome. *Science* 281:1194-1197.

Wood D R (ed.) (1983) *Crop Breeding*, American Society of Agronomy, Madison, Wis., United States of America.

Wricke G & Weber W E (1986) *Quantitative Genetics and Selection Plant Breeding*, Walter de Gruyter and Co., Berlin, Germany.

Xu D, McElroy D, Thornburg R W & Wu R (1993) Systemic induction of a potato pin2 promoter by wounding, methyl jasmonate, and abscisic acid in transgenic rice plants. *Plant Mol Biol* 22:573-588.

Yano M, Katayose Y, Ashikari M, Yamanouchi U, Monna L, Fuse T, Baba T, Yamamoto K, Umehara Y, Nagamura Y & Sasaki T (2000). Hd1, a major photoperiod sensitivity quantitative trait locus in rice, is closely related to the *Arabidopsis* flowering time gene CONSTANS. *Plant Cell* 12:2473-2483.

Zhang H M, Yang H, Rech E L, Golds T J, Davis A S, Mulligan B J, Cocking E C & Davey M R (1988) Transgenic rice plants produced by electroporation-mediated plasmid uptake into protoplasts. *Plant Cell Reports* 7: 379-384.

Zhang J, Zheng H G, Aarti A, Pantuwan G, Nguyen T T, Tripathy J N, Sarial A K, Robin S, Babu R C, Nguyen B D, Sarkarung S, Blum A, & Nguyen H T (2001) Locating genomic regions associated with components of drought resistance in rice: comparative mapping within and across species. *Theor Appl Genet* 103:19-29.

Zhu J K (2002). Salt and drought stress signal transduction in plants. *Ann Rev Plant Bio* 53:247-273.

Zhu T, Budworth P, Chen W Q, Provart N J, Chang H S, Guimil S, Su W, Estes B, Zou G Z & Wang X (2003) Transcriptional control of nutrient partitioning during rice grain filling. *Plant Biotech J* 1:59-70.

Zhu T, Peterson D J, Tagliani L, St Clair G, Baszczynski C L & Bowen B (1999) Targeted manipulation of maize genes in vivo using chimeric RNA/DNA oligonucleotides. *Proc Natl Acad Sci USA* 96:8768-8773.

It will be understood that various details of the presently disclosed subject matter can be changed without departing from the scope of the presently disclosed subject matter. Furthermore, the foregoing description is for the purpose of illustration only, and not for the purpose of limitation.

SEQUENCE LISTING (198 sequences)

SEQ ID NO: 1 - DNA, 1497 bp, Oryza sativa
  CDS (1)..(1497)
atgacgtggccccctatccatccatcccttaccgccttcctctccacgcgtcgccttccgcctccgccacctcctccccctctccacacactcttcttctccactcctccgccgctcgcctcgccgcgcgccgcttatatacccgcgtctctgcgctcatcgattcatcacccagatcgcaatccaaccaccgcaaccaattcgccggagaaagttgtgaataccgacctaccggcggcgaagatcgatgatgtacatgcgcgcgacgcaccgggacgaggaggggaagaaggtgacggagaaggcacttcgagcggaagctggaccagcaggggctccaccgcatggagcgccacccggcgaacggctcccgcggcatcggcgcgccgccgcccaagtccggccgcggcggcaagttcacctgggagggccccgacagcatcgtcgacagccagctcgatccctccggccgccatcgaccgcaacgaccccaactacgaggaggaggaaggcgaccacgagcgcgaggccgacgtcgtcggcgaggtggaggtcgccaaggtcgccggcgacgccagggatggtgtcgccagggtcgacgtcgtcgcgccgccgcagctgcacgagaaactgcagctgcagccgcatctcgtcgctattcctcccccggcgtcgccgccttgtccaccccctccgtcaccatccgtatcccccgccctctccgtcgccgccttgtccgcctcctcagtcgccgtccgcctcccccaccctcgccgccttctcctctccctccgtccccgtacgttttccctgccctctccgtcgccgtccgtcgcccccgccctctccacctccggcaccgttggcgtctcctccccttcagcgtccttgcctcctccgtcgtcttcctaccacgcgtggcatcaggtcagaggcaggcaccggcaggcggcggcgcggccggcagctagtcctcccggcaggcggcgtcgcggccggtggcacggcgcgtcgcatctgtccgacacaagcaccggcaaaagcggtggcgcggtcctggatgacgatcatggagctgtggtttaccctgtcaggaggtcagtagcccctcctgcagttcagcgttggggcgacgtccctgggcagcataactgtggcgcacctggttaccctgagatgattccggcgcaagcacagttctgttgtttgcgttgcaaggctgctattatttttaaaggagtagcctaccagatcaataagaatgcacatgctgctggaggactcattctgcctccagaagatgctgattcaggagcgaagcaaaccataggaacagttccagggggaacatgtcgtccccaagaaaaaatgatactgacacatcatttgttctccgtagcatccgattttgatacaacattagcttacacatttgacagtttgacaggattgcagaagcacaaaggtgcttcgtcgtggtacgagatgtttctttaa

SEQ ID NO: 2 - protein, 498 aa, Oryza sativa
MTWPPIHPSLTAFLSTRRLPPPPPPPPLHTLFFSTPPPLASPRAAYIPASLRSSIHHPDRNPTTATNSPEKVVNTDLPAAKIDDVHARDAPGRGGEEGDGEGTSSGSWTSRGSTAWSATRRTAPAASARRRPSPAAAASSPGRAPTASSTASSIPPAAIDRNDPNYEEEEGDHEREADVVGEVEVAKVAGDARDGVARVDVVAPPQLHEKLQLQPHLVAIPPPASPPCPPPPSPSVSPALSVAALSASSVAVRLPHPRRLLLSLRPRTFSLPSPSPSVAPALSTSGTVGVSSPSASLPPPSSSYHAWHQVRGRHRQAAARPAASPPGRRRRGRWHGASHLSDTSTGKSGGAVLDDDHGAVVYPVRRSVAPPAVQRWGDVPGQHNCGAPGYPEMIPAQAQFCCLRCKAAIIFKGVAYQINKNAHAAGGLILPPEDADSGAKQTIGTVPGGTCRPQEKMILTHHLFSVASDFDTTLAYTFDSLTGLQKHKGASSWYEMFL

SEQ ID NO: 3 - DNA, 249 bp, Oryza sativa
  CDS (1)..(249)
atggcatccatgaagctctccctcgccgtcgtcttcctcctctctgcggtggtggtgatgagcgccatgggcggcgcggaggaggcgaggtgctcggtggtgtgcatccagggaggctacatcacctgcgacaactacccgtaccagaagctggacggctgcgcctgcgagtgcgcgcccaaggacggccagaactgcgtcctccacctcgagcacggcccgccctccaactgcccgcctcaggcctaa

SEQ ID NO: 4 - protein, 82 aa, Oryza sativa
MASMKLSLAVVFLLSAVVVMSAMGGAEEARCSVVCIQGGYITCDNYPYQKLDGCACECAPKDGQNCVLHLEHGPPSNCPPQA

SEQ ID NO: 5 - DNA, 849 bp, Oryza sativa
  CDS (1)..(849)
atggagttccctcatcgccaccaccaccacggccaccgcggcgacgacgacgacgacgatcgccgccgccatcccgctcccgctcccgcctacggccacgactcagcccctccgccgggtccctacggccaagcgcctcctccggctgatccctacgctcgccacccgccttcccacgactacgctcatcctcctccggcgtatgggggagggggctacggcaacgtcgtccacgtttcccacgaggtctccgaccaccagaggcccacgccgcactacggtggatccgagtacatcagccccgtccaagagacccgcccttaccacggtggcggaggagccccaccggtgacccacaggatctactgcaaggccggggaggacaactacagcctcgccgtcagagatggcaaggtctgcctcgtccgctccgatcgcgacgaccacacgcagcactgggtgaaggacatgaagtacagcacgagagtgaaagacgaggaagggtaccctgccatggcgctcgtcaacaaggccaccggcgacgccctcaagcactccatcggccaatcccaccctgtccgtttggtgcgctacaatccagagtacatggacgagtctgtgctgtggacggagagcagggacgttgggagtgggtttcggtgcatcaggatggtgaacaacatctacctcaacttcgacgcgctccatggagacaaggaccacggcggcgtgcgcgacggaaccaccctggtgctctgggagtggtgcgagggtgacaaccagcgctggaagattgttccctggtatgcactgcaggagaaagcagaccacgagacagcgatccgttaa

SEQ ID NO: 6 - protein, 282 aa, Oryza sativa
MEFPHRHHHHGHRGDDDDDDRRRHPAPAPAYGHDSAPPPGPYGQAPPPADPYARHPPSHDYAHPPPAYGGGGYGNVVHVSHEVSDHQRPTPHYGGSEYISPVQETRPYHGGGGAPPVTHRIYCKAGEDNYSLAVRDGKVCLVRSDRDDHTQHWVKDMKYSTRVKDEEGYPAMALVNKATGDALKHSIGQSHPVRLVRYNPEYMDESVLWTESRDVGSGFRCIRMVNNIYLNFDALHGDKDHGGVRDGTTLVLWEWCEGDNQRWKIVPWYALQEKADHETAIR

SEQ ID NO: 7 - DNA, 465 bp, Oryza sativa
  CDS (1)..(465)
atgtcgatgatccgccgcagcaacgtgttcgaccccttctccctcgacctctgggaccccttcgacggcttccccttcggctccggcagcggcagcctcttccctcgcgccaactccgacgcggcggccttcgccggcgcgcggatcgactggaaggagacgcccgaggcgcacgtgttcaaggcggacgtgccggggctgaagaaggaggaggtcaaggtggaggttgaggacggcaacgtcctccagatcagcggcgagcgcatcaaggagcaggaggagaagacggacaagtggcaccgcgtggagcgcagcagcggcaagttcctccgcaggttccggctgccggagaacaccaagccggagcagatcaaggcgtccatggagaacggcgtgctcaccgtcaccgtgcccaaggaggagcccaagaagcccgacgtcaagtccatccagatcaccggctag

SEQ ID NO: 8 - protein, 154 aa, Oryza sativa
MSMIRRSNVFDPFSLDLWDPFDGFPFGSGSGSLFPRANSDAAAFAGARIDWKETPEAHVFKADVPGLKKEEVKVEVEDGNVLQISGERIKEQEEKTDKWHRVERSSGKFLRRFRLPENTKPEQIKASMENGVLTVTVPKEEPKKPDVKSIQITG

SEQ ID NO: 9 - DNA, 597 bp, Oryza sativa
  CDS (1)..(597)
atgccattagcccttgaattgccactccctacggcacattgggcaaagtggtgtggatgtttgagaattgacccacttgagtatgcagtggagatggaaagcgtggttgcaggagccccagatgagcgggcaatcgtcgccggggaacttacaatcagggcagcagccgtcgaatgccatcctgcatataccacaggtttcatcctgggcgtcccatgtccaagaagccaccgaatgccactgaagaatcttgaccttcatcttgaagaaatcggcctagacgggatacgcctcagtccattggaggggaggggagaagagccccttcgccttcgaggtgacgcggcgtcggtgggagtagcacggccgcacgcggcgctccttcgacagctccggggggaagacggattcggtagcgccggactcccgagggtcggggccaagagagagtgggacaagaggaacgggggagccacagccgaggggatggtgcctggtgtttacctgcggagcggagaggaagccttgagctccgccgccgccgcctgctcgccggcgaatcggggagtgagagtggagagagctggagcagtgtga

SEQ ID NO: 10 - protein, 198 aa, Oryza sativa
MPLALELPLPTAHWAKWCGCLRIDPLEYAVEMESVVAGAPDERAIVAGELTIRAAAVECHPAYTTGFILGVPCPRSHRMPLKNLDLHLEEIGLDGIRLSPLEGRGEEPLRLRGDAASVGVARPHAALLRQLRGEDGFGSAGLPRVGAKREWDKRNGGATAEGMVPGVYLRSGEEALSSAAAACSPANRGVRVERAGAV

SEQ ID NO: 11 - DNA, 558 bp, Oryza sativa
  CDS (1)..(558)
atgaagaccgccatgactacttccacccttctcttcctcctcctcgccggcctcaccgccgccgccctcggcacggcggacgacgacaccaccaccaacaccatacgcctcccgaccgacggaggatcagcacagcaggcgccgacgaagaagaagccgtggaagtgctgcgacaacatcgagcggctgccgacgaagaccaacccgccgcagtggcgctgcaacgacgagctggagcccagcaagtgcgtggcacagtgcgaggtgtgccaggaggcgccggggccattcccgggcccgctcatctgcagcgacgtctactggggcgccgacccgggtcccttctgcacgccgcggccgtggggagattgctgcaccaacaccacctgcaccaggtcgatcccgccgatctgccgctgcaacgacaaggtgaagaagtgcgccgccgcgtgcaaggattgcaagcgggtgaagtcgtcgaagcctcctcgctacgtctgccaggaccagttcaccggccagccagggcccaagtgcaaacactcgtgcgagaactag

SEQ ID NO: 12 - protein, 185 aa, Oryza sativa
MKTAMTTSTLLFLLLAGLTAAALGTADDDTTTNTIRLPTDGGSAQQAPTKKKPWKCCDNIERLPTKTNPPQWRCNDELEPSKCVAQCEVCQEAPGPFPGPLICSDVYWGADPGPFCTPRPWGDCCTNTTCTRSIPPICRCNDKVKKCAAACKDCKRVKSSKPPRYVCQDQFTGQPGPKCKHSCEN

SEQ ID NO: 13 - DNA, 603 bp, Oryza sativa
  CDS (1)..(603)
atgtcgctgatccgccgcggcaacgcgttcgaccccttctccctcgacctctgggatcccgtcgacggcttccccttcggctccggcggcagcagcagcagcagcggcagcctcttccctcgggccaactccgacgcggcggccttcgccggcgcgcgcatcgactggaaggagacgcccgaggtgcacgtgttcaaggcggacgtgccggggctgaagaaggaggaggtcaaggtggaggtggacgacggcaacatcctgcagatcagcggcgaacgcagcagggagcaggaggagaagtcggacaagtggcaccgcgttggagcgcagcagcggcaagttcctccgcaggttccgcctccccgagaacaccaagccggagcagatcaaggcgtccatggagaatggcgtgctcaccgtcaccgtgcccaaggaagagcccaagaagcccgacgtcaagtccatccagatctccggctagagccccgtttgtttattctgctgcttctcctcaatgctgcaattgatctcctcctttggtactttgcttgtgtcgtgagggacacagtccaaaatgtgtgtgatatgatcatgtgtttatga

SEQ ID NO: 14 - protein, 200 aa, Oryza sativa
MSLIRRGNAFDPFSLDLWDPVDGFPFGSGGSSSSSGSLFPRANSDAAAFAGARIDWKETPEVHVFKADVPGLKKEEVKVEVDDGNILQISGERSREQEEKSDKWHRVGAQQRQVPPQVPPPREHQAGADQGVHGEWRAHRHRAQGRAQEARRQVHPDLRLEPRLFILLLLLNAAIDLLLWYFACVVRDTVQNVCDMIMCL

SEQ ID NO: 15 - DNA, 918 bp, Oryza sativa
  CDS (1)..(918)
atggcgctccgcacgctggcctcgaggaaaaccctagccgccgcggcgctgccgctggctgcggcggcggcggcgaggggtgtgacgaccgtcgcgctcccggacctcccctacgactacggcgcgctggagccggccatctccggggagatcatgcgcctgcaccaccagaagcaccacgccacctacgtcgccaactacaacaaggccctcgagcagctcgacgccgccgtcgccaagggcgacgcccccgccatcgtgcacctccagagcgccatcaagttcaacggcggaggtgaggccaagtcccgccccccttaccccttcctcgcatacggctttctttctttctttttcttcgtcctgttcatcgcgggcgatgcgggcggcgggggatctgaggaattgggtgggttaggcgttagctgtcttgattgtcatttggttcagccaaacactccgtcaaagggaacagcaggtggtatggtagtaaagaggtatcctcaggacagggctacgttgttccagctgggacccaagctgccgcccactcccaacgctcctgagggtggtggtgatccaccacatgcaaaacttggctgggccattgatgaggattttggttcatttgaggcacttgtaaagaagatgagtgcagaaggtgctgctttacaaggatctggatgggtgtggctagctttggataaagaggcaaagaagctttcagtggaaacaactgctaaccaggaccctctggtaacgaagggggccaacttggttcctttgttgggaattgatgtctgggagcatgcgtactacctgcagtacaagaatgtcaggccagactacctgagcaacatctggaaggtgatgaactggaaatacgcaggggaggtgtacgaaaatgcgactgcttga

SEQ ID NO: 16 - protein, 305 aa, Oryza sativa
MALRTLASRKTLAAAALPLAAAAAARGVTTVALPDLPYDYGALEPAISGEIMRLHHQKHHATYVANYNKALEQLDAAVAKGDAPAIVHLQSAIKFNGGGEAKSRPPYPFLAYGFLSFFFFVLFIAGDAGGGGSEELGGLGVSCLDCHLVQPNTPSKGTAGGMVVKRYPQDRATLFQLGPKLPPTPNAPEGGGDPPHAKLGWAIDEDFGSFEALVKKMSAEGAALQGSGWVWLALDKEAKKLSVETTANQDPLVTKGANLVPLLGIDVWEHAYYLQYKNVRPDYLSNIWKVMNWKYAGEVYENATA

SEQ ID NO: 17 - DNA, 618 bp, Oryza sativa
  CDS (1)..(618)
atgcaacgggcaattcaagctatcgggtcacatggcagtctcctcaagtctgctgttctgcgacacatcagtgctccaaaaccatctattttacctgctgtatattcacgctccatgtcagtttcatctgctcaaatagaggagagtggatttgagactgccactgtggcagatattttgaagtctaaggggaagagtgctgatggatcttggctctggtgcactactgatgactctgtctatgatgctgtcaaatctatgacgcaacacaatgttggagctctggtggttgttaaacctggacaggataaatcaattgctggtattgttactgagagagattacctcaggaaaatcatagtgcagggacgatcttccaagtcaactaaagttggagacatcatgactgaagagaaccagctgatcacggtgaagcctgataccagagtcctgcaagcaatgcagctgatgacagagaagcgcatcaggcacatcccggtgatcgacggcacgggcatggttgggatggtctccattggagacattgtccgcgccgtggtcagcgagcaccgggaagagctgaaccggctcaacgcctacatccagggtggctactag

SEQ ID NO: 18 - protein, 205 aa, Oryza sativa
MQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 19 - DNA, 837 bp, Oryza sativa
  CDS (1)..(837)
atgctgagggttgcggggaggaggctctcgtcgtccctctcatggcgccccgccgccacggcggcggcggccgccggggggccgaggggtggcccgctcgccgggaagaacgacgacgacgacaacaacggcaacggccgggtccagccgcggttctccatcgagtccccgttcttcgccgccgccagagggttttcttcatctgaaacacttgttccaaggaaccaagatactggcttggctgaactacctgcaaccgttgctgcactgaagaatcccaacccaaaggtggtgtacgatgagtacaaccatgagaggcatgcacctggggatcccagcaagcgtgcatttgcttactttgttctaagtggtgggagattcatctatgcatcgttgctgcggctcctcgtattgaaattcgtgctgagcatgtctgcaagtaaggacgtgcttgcgcttgcttccctggaggtggatctctcaagcattgagcctggtaccacagtgacggtgaagtggcgtgggaagccagttttcatcagaaggaggacagaggacgacatagcgctggccaatagcgtggacgttgggtccctgcgccatccccagcaggacgcagagcgtgtgaagaacccagagtggctagtggtcattggcgtctgcacccaccttggttgcattcctctccccaatgctggagatttcggaggttggttctgcccgtgccatggctcccactacgacatctctggcaggattcgcaagggccccgctccattcaacctggaggtccctacctacagtttcttggaggagaacaagctcctcataggctaa

SEQ ID NO: 20 - protein, 278 aa, Oryza sativa
MLRVAGRRLSSSLSWRPAATAAAAAGGPRGGPLAGKNDDDDNNGNGRVQPRFSIESPFFAAARGFSSSETLVPRNQDTGLAELPATVAALKNPNPKVVYDEYNHERHAPGDPSKRAFAYFVLSGGRFIYASLLRLLVLKFVLSMSASKDVLALASLEVDLSSIEPGTTVTVKWRGKPVFIRRRTEDDIALANSVDVGSLRHPQQDAERVKNPEWLVVIGVCTHLGCIPLPNAGDFGGWFCPCHGSHYDISGRIRKGPAPFNLEVPTYSFLEENKLLIG

SEQ ID NO: 21 - DNA, 651 bp, Oryza sativa
  CDS (1)..(651)
atggtgaaggctgttgctgtgcttgctagcagtgagggtgtcaagggcaccatctttttctcccaagagggagatggtaattcacctaaacacgcagcgacaacttgtattctgtccttcccgtgttctttgggcgtaatttgttgccttccgtatttaggtccgacctctgtgacgggaagtgtctctgggctcaagccagggctccatggattccatgtgcacgcgctcggtgacaccactaatggctgcatgtcaactggaccacacttcaatcctactgggaaggaacatggggcaccacaagatgagaaccgccatgccggtgatcttggaaatataacagctggagcagatggtgttgctaatgtcaatgtctctgacagccagatcccccttactggagcacactccatcattggccgagctgttgttgtccatgctgatcctgatgatcttggcaagggtggacatgagcttagcaagaccactggaaatgctgggggccgagttgcttgcgaactcccatcaaatccgtctgttcttatgatgcttgctcttctctggttcaggaatcatcggactccagggttagacgtctcaactttccaacatacagaagctgttcatgttcgctcgtatggatgttga

SEQ ID NO: 22 - protein, 216 aa, Oryza sativa
MVKAVAVLASSEGVKGTIFFSQEGDGNSPKHAATTCILSFPCSLGVICCLPYLGPTSVTGSVSGLKPGLHGFHVHALGDTTNGCMSTGPHFNPTGKEHGAPQDENRHAGDLGNITAGADGVANVNVSDSQIPLTGAHSIIGRAVVVHADPDDLGKGGHELSKTTGNAGGRVACELPSNPSVLMMLALLWFRNHRTPGLDVSTFQHTEAVHVRSYGC

SEQ ID NO: 23 - DNA, 1950 bp, Oryza sativa
  CDS (1)..(1950)
atggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttgatgccaagcgtctcattggcaggaggtttagcgatgcttctgttcagagtgacattaagctctggcccttcaaggtgattgctggacctggtgacaagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtctccctccttaccattgaggagggtatctttgaggtcaaggccacagctggtgacacccatcttggtggtgaagattttgacaatcgtatggtcaaccactttgtgcaagaattcaagaggaagaacaagaaggatatcactggcaaccccagggctctcaggaggttgaggacagcttgtgagagggcaaagaggaccctgtcctccactgcccagaccaccattgagatcgattccctgtatgagggcatcgacttctactcaaccatcacccgtgccaggtttgaggagctcaacatggatctcttcaggaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagtacaagtcagaggatgaggagcacaagaagaaggtggagtccaagaacgcgctggagaactacgcctacaacatgcgcaacaccatcaaggatgagaagatcgcctcgaagctcccggcagcggacaagaagaagatcgaggatgccatcgaccaggccatccagtggctggacggcaaccagctcgctgaggctgatgagttcgatgacaagatgaaggagctggagggcatctgcaaccccatcatcgccaagatgtaccagggcgctggcgcggacatggccggcggcatggacgaggacgatgctcccccggctggcggcagcggtgctggccccaagatcgaggaggtcgactaa

SEQ ID NO: 24 - protein, 649 aa, Oryza sativa
MAGKGEGPAIGIDLGTTYSCVGVWQHDRVEIIANDQGNRTTPSYVGFTDSERLIGDAAKNQVAMNPINTVFDAKRLIGRRFSDASVQSDIKLWPFKVIAGPGDKPMIVVQYKGEEKQFAAEEISSMVLIKMREIAEAYLGTTIKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSSVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVESKNALENYAYNMRNTIKDEKIASKLPAADKKKIEDAIDQAIQWLDGNQLAEADEFDDKMKELEGICNPIIAKMYQGAGADMAGGMDEDDAPPAGGSGAGPKIEEVD

SEQ ID NO: 25 - DNA, 1947 bp, Oryza sativa
  CDS (1)..(1947)
atggcgaagggagagggcccggcgatcggcatcgacctcggcaccacctactcgtgcgtcggcgtgtggcagcacgaccgggtggagatcatcgccaacgaccaggggaaccgcaccacgccgtcgtatgtcgcgttcaccgactccgagcggctcatcggcgacgccgccaagaaccaggtcgccatgaaccccatcaacaccgtcttcgatgccaagcgactgataggtaggcggttctccgacccgtccgtgcagagtgacatgaagctgtggccgttcaaggtcatccctggccccggcgataagcctatgattgtggtgcagtacaagggcgaggagaagcagttctccgccgaggagatctcctccatggtgctcatcaagatgagggagatcgctgaagcctacctcggctccaacatcaagaacgccgtggtgactgtgccggcctacttcaacgactcgcagaggcaggccaccaaggacgccggtgtcattgccggcctcaacgtgatgcgcatcatcaacgagcccaccgccgcggccatcgcctacggtcttgacaagaaggccaccagctccggcgagaagaacgtgctcatcttcgatcttggcggtggcacgttcgatgtgtcgctgctcaccattgaggagggcattttcgaggtgaaggccactgctggtgacactcaccttggtggtgaggacttcgacaaccgcatggtgaaccatttcgtcctggagttcaagcgcaagaacaagaaggacatcagcggcaacccgcgtgctctgcgccggctgcgcacggcctgcgagcgcgccaagcgcacgctgtcgtcgaccgcacagaccaccattgagatcgactccctgtacgagggcatcgacttctactcgaccatcaccagggctcgcttcgaggagctcaacatggacctgttccgcaagtgcatggagccggtggagaagtgcctgcgcgacgccaagatggacaagagcagcgtgcacgacgtcgtgctcgtcggcggctccacccgcatccccaaggtgcagcagctgcttcaggacttcttcaacggcaaggagctgtgcaagagcatcaaccccgacgaggccgtggcatacggcgccgctgtccaggccgccatcctcagcggcgagggcaacgagaaggtgcaggacctgcttctgctcgacgtcacgccgctgtcgctggggctcgagacagcaggaggtgtcatgaccgtgctcatcccgaggaacaccaccatccccaccaagaaggagcaggtgttctcgacctactccgacaatcagcctggcgtcctgatccaggtgtacgagggtgagcgtgcccggaccaaggacaacaacctgctgggcaagttcgagctctccggcatccctccagctccccgcggcgtgccccagatcaccgtctgctttgacatcgacgccaatggcatcctcaacgtctctgccgaggacaagaccaccgggcagaagaacaagatcaccatcaccaacgacaagggcaggctgagcaaggaggagatcgagaagatggtgcaggaggcggagaagtacaaggcggaggacgaggagcacaagaagaaggtggacgccaagaacgcgctcgagaactacgcctacaacatgaggaacaccatcaaggacgacaagatcgcctccaagctctcggcggacgacaagaagaagatcgaggacgccatcgacggcgccatcaactggctcgacagcaaccagctcgcggaggcggacgagttcgaggacaagatgaaggagctggagagcatctgcaaccccatcatcgcgaagatgtaccagggcgccggcgcggacatgggcggcgccgctggcatggacgaggacgcgccggcgggtggcagcggtgcaggccccaagatcgaggaggtcgattaa

SEQ ID NO: 26 - protein, 648 aa, Oryza sativa
MAKGEGPAIGIDLGTTYSCVGVWQHDRVEIIANDQGNRTTPSYVAFTDSERLIGDAAKNQVAMNPINTVFDAKRLIGRRFSDPSVQSDMKLWPFKVIPGPGDKPMIVVQYKGEEKQFSAEEISSMVLIKMREIAEAYLGSNIKNAVVTVPAYFNDSQRQATKDAGVIAGLNVMRIINEPTAAAIAYGLDKKATSSGEKNVLIFDLGGGTFDVSLLTIEEGIFEVKATAGDTHLGGEDFDNRMVNHFVLEFKRKNKKDISGNPRALRRLRTACERAKRTLSSTAQTTIEIDSLYEGIDFYSTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQITVCFDIDANGILNVSAEDKTTGQKNKITITNDKGRLSKEEIEKMVQEAEKYKAEDEEHKKKVDAKNALENYAYNMRNTIKDDKIASKLSADDKKKIEDAIDGAINWLDSNQLAEADEFEDKMKELESICNPIIAKMYQGAGADMGGAAGMDEDAPAGGSGAGPKIEEVD

SEQ ID NO: 27 - DNA, 690 bp, Oryza sativa
  CDS (1)..(690)
atggagcacagcttcaaaaccatagcagctggagtggtgatcgtcgtgctgctcctgcagcaggcgcccgtgctgattcgggccaccgacgcggaccctctccaggacttctgcgtcgccgacctcgacagcaaggtcacggtgaacgggcacgcgtgcaagccggcgtcggccgccggcgacgagttcctcttctcctccaagattgccacgggcggcgacgtgaacgccaacccgaacggctccaacgtcacggagctcgacgtcgccgagtggcccggcgtcaacacgctcggcgtgtccatgaaccgcgtcgacttcgcgcccggtggcaccaacccgccgcacgtccacccgcgcgccaccgaggtcggcatcgtgctccgcggcgagctcctcgtcggcatcatcggcaccctcgacaccgggaacaggtactactccaaggtggtccgtgccggcgagacgttcgtcatcccgagggggctcatgcacttccagttcaacgttggcaagacggaggccaccatggtggtgtccttcaacagccagaaccccggcatcgtcttcgtcccgctcacattgttcggctccaacccgcccatcccgacgccggtgcttgtcaaggcactccgcgtggatgctggtgtagttgagctgctcaagtccaaattcaccggcgggtactaa

SEQ ID NO: 28 - protein, 229 aa, Oryza sativa
MEHSFKTIAAGVVIVVLLLQQAPVLIRATDADPLQDFCVADLDSKVTVNGHACKPASAAGDEFLFSSKIATGGDVNANPNGSNVTELDVAEWPGVNTLGVSMNRVDFAPGGTNPPHVHPRATEVGIVLRGELLVGIIGTLDTGNRYYSKVVRAGETFVIPRGLMHFQFNVGKTEATMVVSFNSQNPGIVFVPLTLFGSNPPIPTPVLVKALRVDAGVVELLKSKFTGGY

SEQ ID NO: 29 - DNA, 1461 bp, Oryza sativa
  CDS (1)..(1461)
atggaggcgccgccggcgatgtatcgcgtgcagaggcgcgcgataccgagccgggttttggttgcgggaaggatccttctcgcgctctgcgccgggttctggctggtagttgctgcggcgctccgcgcccccgccgacgagggtgggcaatgcgggaaccagatcggcgccaagttctgggaggtggtgtgcgcggagcacgggatcgacgccaccgggcgctacgacggcgactccgacctgcagctggagcgcgtcaacgtgtactacaatgaggcctcctgcgggcgcttcgtcccgcgcgccgtgctcatggacctggagccgggcaccatggactccgtccgctccggcccctacggccacatcttccgcccggacaacttcgtcttcggccagtccggcgccggcaacaactgggccaagggacactacaccgagggcgccgagctcatcgacgccgtcctcgacgtcgtacgaaaggaggccgagaactgcgactgcctccaagggttccaggtttgccactcgcttggcggcggcacggggtccggcatgggcacgctcctcatctccaagatccgggaggagtaccccgaccggatgatgctcaccttctccgtcttcccctcgcccaaggtctccgacaccgtggtggagccctacaacgccaccctctccgtccaccagctcgtcgagaacgccgacgagtgcatggtgctcgacaacgaggccctctacgacatctgcttccgcaccctcaagctcaccaccccaagcttcggcgacctcaaccacctcatctccgccaccatgagcggcgtcacctgctgcctccgcttccccggccagctcaactccgacctccgcaagctcgccgtcaacctcatccccttccctcgcctccacttcttcatggtcggcttcgccccgctcacctcccgcggctcgcagcagtaccgcgccctcaccgtcccggagctcacccagcagatgtgggacgccaagaacatgatgtgcgccgccgacccccgccacggccgctacctcaccgcctccgccatgttccgcggcaagatgtccaccaaggaggtggacgagcagatgctcaacgtccagaacaagaactcctcctacttcgtcgagtggatccccaacaatgtcaagtccaccgtctgcgacatcccccccaccggcctcaagatggcctccaccttcatcggcaactccacctccatccaggagatgttccgccgcgtcagcgagcagttcaccgccatgttccgcaggaaggccttcttgcactggtacacgggcgagggcatggacgagatggagttcaccgaggctgagagcaacatgaacgacctcgtctccgagtaccagcagtaccaggacgccaccgccgacgacgagggtgaatacgaggatgaggaagaagaggctgatctccaggactaa

SEQ ID NO: 30 - protein, 486 aa, Oryza sativa
MEAPPAMYRVQRRAIPSRVLVAGRILLALCAGFWLVVAAALRAPADEGGQCGNQIGAKFWEVVCAEHGIDATGRYDGDSDLQLERVNVYYNEASCGRFVPRAVLMDLEPGTMDSVRSGPYGHIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADDEGEYEDEEEEADLQD

SEQ ID NO: 31 - DNA, 2805 bp, Oryza sativa
  CDS (1)..(2805)
atgcaggtttggtgcatgatcgatcgtgatgggcggggtttgccgttaggattcgatcgatcttacaggagagtaccggttgcaaagcgtggagtatactcctacgtgcgtagcgtttccataatgggcatgcgtgcgtgtatagttgtataccagtcagtcgagtcggtcggtcttatccggccggggatagcgagttcggcctcactccgtagcactgctgagcatcccttcaagaacattttgaccaccctccctaagcctgggggtggtgaatatgggaaattctacagccttcctgcactaaatgatcccaggattgataagctgccctactctatccgtattcttctagagtcagctatccgcaactgtgataacttccaagtcaaccagaatgatgttgagaaaattattgattgggagaatacatctcccaagctggctgaaatacctttcaagccagcacgagttcttcttcaggacttcactggagttccagctgtcgtagatcttgcagctatgcgtgacgcgatggccaagttgggcagtgatgccaacaagatcaatccactggttccagtggatcttgtaattgaccactcagtgcaggtggatgttgcaaggtcaccaaatgctgtgcaatcaaacatggagttggagtttaagcgtaacaatgaaagatttggtttccttaaatggggttctactgctttccacaatatgttggttgtaccccctggttcaggaattgtgcaccaggtcaatcttgagtatcttggtcgagttgttttcaacacagatggaattatgtatcctgacagtgtggttggtaccgattcacacaccactatgattgatggtttgggtgttgctggttggggagttggtggaattgaagcagaggccacaatgcttggtcagccaatgagcatggttttgcctggtgttgttgggttcaagttgactgggaagttacagaatggtgtcactgctaccgaccttgttcttactgtcacccaaatgttaaggaagcacggcgttgttggcaaatttgttgaattctatggcgaaggcatgggaaagctttctttggctgacagggccacaatcgcaaacatgtcacctgaatatggagccacaatgggtttcttccctgtagaccacgtgacactagattatcttaaattgactggccggagtgatgaaactgtggcaatgattgaagcatatctgcgagctaacaagatgtttgtagactacaatgaggaaatgaaatctgactggcattcttgcctggataacagagttggtttcaagggttttgctgtaccaaaggaacaacaagataaagttgtgaaatttgacttccatggacaacctgctgaactcaaacatggcagtgttgtcatagcagcaattactagctgcacaaacacatcaaatcctagtgttatgcttggtgctgcccttgtggcaaagaaagcctgtgaactgggtcttgaggtgaaaccatgggtaaagacaagccttgcccctggatctggggttgtcactaaatacttgttacagagtggccttcaagaatacttgaacaagcaaggtttccatgttgttggatatggttgtaccacttgcattggcaactctggtgatctagatgaatctgtatcagctgccatttcagaaaatgatgttgttgctgctgctgttctgtcgggcaaccgtaacttcgagggtcgtgtgcacccattgacccgggctaattaccttgcttcaccgcctcttgtggttgcatatgcacttgctggcactgttgacattgattttgagaaagagccgattggagttggaaaggatggtaaagaagtcttcttcagggacatatggccctcaactgaagaaattgcagaagtggtccaatctagcgtactgcctgatatgttcaaaagtacatacgaggctattacaaaaggcaacccgatgtggaatcagctgaccgtgcccgaagcatcgctctattcgtgggatccaaactccacctacatccatgagcctccatactttaaggacatgaccatgtccccacctggcccccatggggtgaagaatgcctactgcttactgaactttggggacagcattacgacagaccatatttcaccagcaggtagcattcacaaagacagccctgctgccaagtacttgcttgagcgtggtgtggaccgtaaggacttcaattcatatggtagccgtcgtggtaatgatgaagtaatggcaagaggaacatttgcgaacatcaggattgtgaacaagtttttgaatggagaagttggacccaagaccgttcatgtccctacaggggagaagctctatgtatttgatgctgccttgaaatacaagtctgagggtcatgacactattgttcttgctggtgctgagtatggaagtggcagttctcgtgactgggctgccaagggaccgatgctcctgggtgttaaagctgtgatcgctaagagctttgagcgtatccaccgaagcaacctggtgggtatgggaatcattcctctctgcttcaaggctggtgaggatgccgactcacttggccttactggacatgagcggtataccatcgacctcccgaccaacgtcagcgagatccgtcccgggcaggacattaccgtcacaaccgacaacgggaaatccttcacttgtactcttcgctttgacacagaggtggaactggcatacttcaaccatggaggcatcctcccatacgtcatccgcaacctggcgcagaactag

SEQ ID NO: 32 - protein, 934 aa, Oryza sativa
MQVWCMIDRDGRGLPLGFDRSYRRVPVAKRGVYSYVRSVSIMGMRACIVVYQSVESVGLIRPGIASSASLRSTAEHPFKNILTTLPKPGGGEYGKFYSLPALNDPRIDKLPYSIRILLESAIRNCDNFQVNQNDVEKIIDWENTSPKLAEIPFKPARVLLQDFTGVPAVVDLAAMRDAMAKLGSDANKINPLVPVDLVIDHSVQVDVARSPNAVQSNMELEFKRNNERFGFLKWGSTAFHNMLVVPPGSGIVHQVNLEYLGRVVFNTDGIMYPDSVVGTDSHTTMIDGLGVAGWGVGGIEAEATMLGQPMSMVLPGVVGFKLTGKLQNGVTATDLVLTVTQMLRKHGVVGKFVEFYGEGMGKLSLADRATIANMSPEYGATMGFFPVDHVTLDYLKLTGRSDETVAMIEAYLRANKMFVDYNEEMKSDWHSCLDNRVGFKGFAVPKEQQDKVVKFDFHGQPAELKHGSVVIAAITSCTNTSNPSVMLGAALVAKKACELGLEVKPWVKTSLAPGSGVVTKYLLQSGLQEYLNKQGFHVVGYGCTTCIGNSGDLDESVSAAISENDVVAAAVLSGNRNFEGRVHPLTRANYLASPPLVVAYALAGTVDIDFEKEPIGVGKDGKEVFFRDIWPSTEEIAEVVQSSVLPDMFKSTYEAITKGNPMWNQLTVPEASLYSWDPNSTYIHEPPYFKDMTMSPPGPHGVKNAYCLLNFGDSITTDHISPAGSIHKDSPAAKYLLERGVDRKDFNSYGSRRGNDEVMARGTFANIRIVNKFLNGEVGPKTVHVPTGEKLYVFDAALKYKSEGHDTIVLAGAEYGSGSSRDWAAKGPMLLGVKAVIAKSFERIHRSNLVGMGIIPLCFKAGEDADSLGLTGHERYTIDLPTNVSEIRPGQDITVTTDNGKSFTCTLRFDTEVELAYFNHGGILPYVIRNLAQN

SEQ ID NO: 33 - DNA, 1014 bp, Oryza sativa
  CDS (1)..(1014)
atgggcaagattaagatcggaatcaacggtttcggaaggatcgggaggctcgtggccagggtggccctccagagcgaggatgtcgagctcgtcgccgtcaacgaccccttcatcaccaccgactacatgacctacatgttcaagtacgataccgtgcacggccaatggaagcacagcgacatcaagatcaaggactccaagactctgctcttgggcgagaagccggtcaccgttttcggcatcaggaaccctgacgagattccgtgggctgaggctggtgctgagtatgtcgtggagtccaccggtgtcttcactgacaaggagaaggcttcttctcacttgaagggtggtgccaagaaggttttcatctcagccccgagcaaagatgctccgatgtttgtctgcggtgtcaacgaggacaagtacacttcagatattgatattgtctcaaatgctagctgcaccacaaactgccttgctcctcttgccaaggtcattcatgacaactttggtattatcgagggtctgatgacaactgttcatgccatcactgccacccaaaagaccgttgatggaccgtccagcaaggactggaggggtggcagggcggccagttttaacatcattcccagcagcactggtgctgccaaagctgttggcaaggttcttcctgatttgaatggcaagcttacgggaatgtccttccgtgttcccactgtcgatgtctcagttgttgatctcacagttagaatcgagaaggctgcctcatatgatgctatcaagagtgctatcaagtctgcatcagagggaaagctcaagggaatcataggatatgttgaggaagacctggtttctactgactttgttggtgacagcaggtcgagcatcttcgacgccaaggctggaattgctcttaacgataactttgtcaagcttgtcgcctggtacgacaacgagtggggttacagcaaccgtgtcatcgacctgatccgccacatggccaagacccagtag

SEQ ID NO: 34 - protein, 337 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 35 - DNA, 456 bp, Oryza sativa
  CDS (1)..(456)
atggcgcagctggtggacaaggcgaaggggttcgtggcggacaaggtggcgcgggtggagaagccggaggcggagctggccgagctgtcgttccagagcgtgggccgcggcggcgccaccctcgcggggcgcgtggacgtgcgcaacccctactcccactccatcccgatctgcgaggtgagctactcgctgaagagcgccgggagggaggtggcgtcggggacgatgcccgacccggggtcgctcaccgccggcgacaccacgcggctggacatcccggtgaaggtgccgtacgacttcctggtgagcctcgccagggacgccggcagggactgggacatcgactacgagatgagggtcggcctcaccgtcgacctccccatcctcggcaacttcaccctgccgctcaccaagtccggcgagctcaagctccccaccctctccgacgtcttctaa

SEQ ID NO: 36 - protein, 151 aa, Oryza sativa
MAQLVDKAKGFVADKVARVEKPEAELAELSFQSVGRGGATLAGRVDVRNPYSHSIPICEVSYSLKSAGREVASGTMPDPGSLTAGDTTRLDIPVKVPYDFLVSLARDAGRDWDIDYEMRVGLTVDLPILGNFTLPLTKSGELKLPTLSDVF

SEQ ID NO: 37 - DNA, 804 bp, Oryza sativa
  CDS (1)..(804)
atgccgtcgacgcttagaaaaagtactactagacgcagaataaaggagggaacgtccggaaatccacgtcgcactcctggacacttgaatcagtggcaaccatcaattcgcatgctggccgtgtacgtacgtggcgccgcgctgatcgacatgcatcctctcgctgatcatgctcgatcagcattgtttagctttacgcccacctggatcacaatgtgccgtgctgtcctcgtctctgacatgatccggttgcaatattttatccctcgccggagcagcataaatacccagcaaaaccttgcagtaatcggaatccattcagtgccaatcaggctaggtatagcgagaatggagtaccaggggcagcatggtggccacgccagcagccgcgccgacgagcacggcaaccctgcagtgaccaccggaaacgcacccaccgggatgggcgccggccacatccaggagccggcgagggaggacaagaagaccgacggcgtcctccgccgctccggcagctccagctccagctcatcctctgaggacgatgggatgggaggaaggaggaagaaggggatcaaggagaagatcaaggagaagctccccggcggcaacaagggcaacaaccagcagcagcagcaggagcacaccacaacaacgaccggcggcgcgtacgggccgcagggccacgataccaagatcgccaccggcgcacacggcggcaccgccgccaccaccgcggacgccggcggcgagaagaagggcatcgtggacaagatcaaggagaagctccccggccagcactga

SEQ ID NO: 38 - protein, 267 aa, Oryza sativa
MPSTLRKSTTRRRIKEGTSGNPRRTPGHLNQWQPSIRMLAVYVRGAALIDMHPLADHARSALFSFTPTWITMCRAVLVSDMIRLQYFIPRRSSINTQQNLAVIGIHSVPIRLGIARMEYQGQHGGHASSRADEHGNPAVTTGNAPTGMGAGHIQEPAREDKKTDGVLRRSGSSSSSSSSEDDGMGGRRKKGIKEKIKEKLPGGNKGNNQQQQQEHTTTTTGGAYGPQGHDTKIATGAHGGTAATTADAGGEKKGIVDKIKEKLPGQH

SEQ ID NO: 39 - DNA, 285 bp, Oryza sativa
  CDS (1)..(285)
atggcgaaggtggcgttggcggtggcggcgatggcggtgctgctgctgctcgcggcggcggcggcgccgggggcggaggcggcgtgcgacgcgctgcagctgtcgccgtgcgcgagcgcgatcatcgggaacgcgtcgccgtcggcgtcgtgctgcagccggatgaaggagcagcagccgtgcctgtgccagtacgcgcgcgacccaaacctgcagcgctacgtcaactcccccaacggcaagaaggtcttggccgcctgccacgtccccgtcccctcctgctaa

SEQ ID NO: 40 - protein, 94 aa, Oryza sativa
MAKVALAVAAMAVLLLLAAAAAPGAEAACDALQLSPCASAIIGNASPSASCCSRMKEQQPCLCQYARDPNLQRYVNSPNGKKVLAACHVPVPSC

SEQ ID NO: 41 - DNA, 243 bp, Oryza sativa
  CDS (1)..(243)
atggcgtcgcggccgtcgctgaagccgaagcccaaggtcaagggcgcgaggaagggatccccggcggccgacgaggagcagtccacggctgcggcggcggtgcggttcgtcaaggagtggaccacgtggaccatgaagaagaccaaggtggcggcgcactacggcttcatcccgctcatcatcgtcgtcggcatgagatccgagccgaggccctccctcgcccagctcctcagcccggtctga

SEQ ID NO: 42 - protein, 80 aa, Oryza sativa
MASRPSLKPKPKVKGARKGSPAADEEQSTAAAAVRFVKEWTTWTMKKTKVAAHYGFIPLIIVVGMRSEPRPSLAQLLSPV

SEQ ID NO: 43 - DNA, 225 bp, Oryza sativa
  CDS (1)..(225)
atgggcgagacgacgccgacgacgtacgagtcggtgggcggcggggagaaccgcacgcgcacggacctgcgttcgcgggaggaccagggcgccatccagatcgacaaggtgcaggacaaggtcgacgagcccgccgcgcgcaaggtggacgaccgcgccttcgacgccaagcaggtcggccacggcgccggcgccgacgccggggccaccgggaccggcgcgtga

SEQ ID NO: 44 - protein, 74 aa, Oryza sativa
MGETTPTTYESVGGGENRTRTDLRSREDQGAIQIDKVQDKVDEPAARKVDDRAFDAKQVGHGAGADAGATGTGA

SEQ ID NO: 45 - DNA, 2940 bp, Oryza sativa
  CDS (1)..(2940)
atgattgcgcatgtgagtgccgaaagtgcagttgaagagagtactgagaaggagcaaactgttgaaagcgaggccagtgaatctgtggagattgttggtgttgagaagcctactgaggatgagagtaatgttgatggcggtgctagttctgttgtgtctcgagaattggctccagaggaaaccaaggaaaataatgttggtcaggaggatgaaggtgttgctgaggttattgaccgtgaagaagacgctgatgatgatgaagagatagttttagctgcagctgatgatgaagatgatggtactaacgaggctgatgacgatgaagatggagtgagctctgacagggggcctgcacgagttgctattatagagagttcagaagctgcgaagcagatcatgaaggagcttggggaaggttctgctagtgttagtcctgtatctggcttgagcagctcgagagagtacactaatagcatggatgggcagattgtccttgatgattctgaggaggatggggatgatgacgataatgaagatgacgatgagaaggggtttgattctgctgccttggctgccctgctgaaagcagcaactggtgcatctgcagacgggaatgtcacagtttcttcccaagatggctctagaatcttctccatggatcggccagctggcctgggctcatcagccccatctctcaggccaacagtcccacgcccagttgcacggtcaaacctattcagcccctctgagctagcagtgactgctgagcctactgaggagatgacggaggaagagaagaagctgcatgacaaggttgagttgatccgagtaaagtttctgcgccttgtctatagattgggggctactcctgaagaaacagttgcagcacaggtgttgtaccgtctgagccttgctgagggtattcgacacggaaggcagacaaaccgagctttcagccttgacaatgcacggaagaaggccatgctgcttgaagcggagggaaaagaggagttgaacttctcatgcaacatacttgttttggggaagataggggtcggaaaaagtgcaactataaattcaatttttggtgaagagaagtccaaaactgatgctttcagttcagccaccaacagtgtacgggagattgttggtaatgtcgatggtgtccagatacggatcattgatactccaggccttcgacccaatgtgatggaccaaggatccaacagaaaaatcctcgcttctgtcaagaaatataccaagagatgccccccagatattgttctgtatgtggaccgcctggatagtctgagccgtgatctcaatgatttgcctcttctaaagaccattacttctgttctgggctcatctatatggttcaatgccattgttgctctcactcatgctgcttccgcccctcctgaaggtctaaatggtgcccctatgacatatgaggtgctaatggctcagaggtctcacattatccagcaatccatcaggcaagctgcaggagatatgcggttgatgaatccagtagctcttgttgagaaccatccttcttgcaggagaaaccgcgagggtcagaaagtacttccaaatggccagagctggaggcatcagatgctgcttttgtgctactcttcaaagatattgtctgaagcaaactcacttctgaaacttcaggatccaaatcctggaaagctttttgggttccgtttccgctctccgcctctgcccttcctgctctcctccctgttgcagtcaagagctcacccgaagctttcaccagatcagggtggcaatgaaggagattctgacatcgatttggatgattactctgatatagagcaggatgaagatgaagaggaatatgaccagcttcctcccttcaagccattgaccaaatctcagcttgcgaggctgacaaaggagcagaagaatgcttattttgatgagtacgactacagggtcaagcttctccagaagaaacagtggaaggatgagatccgcaggttgaaggagatgaagaagagaggtaaaactgatatggatgcttatgggtatgctaacatcgcaggagaaaatgatctggatcctcctccagagaacgtatcagttcccttacctgatatggtgctgcccccttcatttgactgtgacaatcccacataccggtaccgctttctggagccaacttcgactgttcttgcaaggcctgtgttagatgcacacgggtgggatcatgactgtggttatgacggagtaagtgttgaggagacgcttgctctccttaacaagtttccagctaatatggcggttcaggtcaccaaggacaagaaggaatttagcatccatttggactcttccatctcagcaaagcttggggaggatgcatcgtcgcttgctggttttgatatccagactgttgggcggcagcttgcgtacattctccgtggtgaaaccaagttcaagaatatcaagaagaacaagactactggaggattttcagtgactttcttgggcgacattgtggcgactgggctgaaggttgaggaccagctctctcttgggaagaggttggcactggtggcgagcacaggtgcaatgcgagctcaaggcgacaccgcttatggagctaacttggaggcacgcctgaaagacaaagattatccgattggccagtccctgtcaaccctgggtctttctttgatgaagtggcgccgagaccttgctctcggtgcgaatttgcagtcccagttctcgattggaaggggctcgaagatggtggttcgtcttggattgaataacaaactaagtggccagatcactgtcaggacaagcacctcggagcaggtccagatcgcgctgttgggtcttatcccagttgcagcctccatttacaggagcttcaggcccagcgaaccctccttcgcctattag

SEQ ID NO: 46 - protein, 979 aa, Oryza sativa
MIAHVSAESAVEESTEKEQTVESEASESVEIVGVEKPTEDESNVDGGASSVVSRELAPEETKENNVGQEDEGVAEVIDREEDADDDEEIVLAAADDEDDGTNEADDDEDGVSSDRGPARVAIIESSEAAKQIMKELGEGSASVSPVSGLSSSREYTNSMDGQIVLDDSEEDGDDDDNEDDDEKGFDSAALAALLKAATGASADGNVTVSSQDGSRIFSMDRPAGLGSSAPSLRPTVPRPVARSNLFSPSELAVTAEPTEEMTEEEKKLHDKVELIRVKFLRLVYRLGATPEETVAAQVLYRLSLAEGIRHGRQTNRAFSLDNARKKAMLLEAEGKEELNFSCNILVLGKIGVGKSATINSIFGEEKSKTDAFSSATNSVREIVGNVDGVQIRIIDTPGLRPNVMDQGSNRKILASVKKYTKRCPPDIVLYVDRLDSLSRDLNDLPLLKTITSVLGSSIWFNAIVALTHAASAPPEGLNGAPMTYEVLMAQRSHIIQQSIRQAAGDMRLMNPVALVENHPSCRRNREGQKVLPNGQSWRHQMLLLCYSSKILSEANSLLKLQDPNPGKLFGFRFRSPPLPFLLSSLLQSRAHPKLSPDQGGNEGDSDIDLDDYSDIEQDEDEEEYDQLPPFKPLTKSQLARLTKEQKNAYFDEYDYRVKLLQKKQWKDEIRRLKEMKKRGKTDMDAYGYANIAGENDLDPPPENVSVPLPDMVLPPSFDCDNPTYRYRFLEPTSTVLARPVLDAHGWDHDCGYDGVSVEETLALLNKFPANMAVQVTKDKKEFSIHLDSSISAKLGEDASSLAGFDIQTVGRQLAYILRGETKFKNIKKNKTTGGFSVTFLGDIVATGLKVEDQLSLGKRLALVASTGAMRAQGDTAYGANLEARLKDKDYPIGQSLSTLGLSLMKWRRDLALGANLQSQFSIGRGSKMVVRLGLNNKLSGQITVRTSTSEQVQIALLGLIPVAASIYRSFRPSEPSFAY

SEQ ID NO: 47 - DNA, 492 bp, Oryza sativa
  CDS (1)..(492)
atggagcaccaggggcagcacggccacgtgaccagccgcgtcgacgagtacggcaacccggtcggcaccggcgccggacacgcgcagatgggcaccgccggcatggggacgcacggcaccgccggcaccggccgccagttccagccgatgagggaggagcacaagaccggcggcgtcctgcaacgctccggcagctccagctcaagctcgtctgaggatgatggaatgggagggaggaggaagaaggggatcaaggagaagatcaaggagaagctccccggcggcaacaagggcgagcagcagcatgccatgggcggcaccggcaccggcaccggcaccggcaccggaaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactga

SEQ ID NO: 48 - protein, 163 aa, Oryza sativa
MEHQGQHGHVTSRVDEYGNPVGTGAGHAQMGTAGMGTHGTAGTGRQFQPMREEHKTGGVLQRSGSSSSSSSEDDGMGGRRKKGIKEKIKEKLPGGNKGEQQHAMGGTGTGTGTGTGTGGAYGQQGHGTGMTTGTTGAHGTTTTDTGEKKGIMDKIKEKLPGQH

SEQ ID NO: 49 - DNA, 159 bp, Oryza sativa
  CDS (1)..(159)
atggcgtcggcgacgttcctggaggtgctcctagccatcttcctgccgccggtcggcgtcttcctgcgctacggcttgggtgagttctggatcgatctcttgctgaccatactgggatacatcccggggatcatctacgcggtgtgcaatagcaactga

SEQ ID NO: 50 - protein, 52 aa, Oryza sativa
MASATFLEVLLAIFLPPVGVFLRYGLGEFWIDLLLTILGYIPGIIYAVCNSN

SEQ ID NO: 51 - DNA, 495 bp, Oryza sativa
  CDS (1)..(495)
atggacaactaccaggggcagcacggctacggcgccgaccgcgtcgacgtgtacggcaacccggtcggcgccggccagtacggcggcggcgccaccgcgcccggcggaggccacggagcgatggggatgggaggtcatgccggcgccggcgccggcggccagttccagccggcgagggaggaccacaagaccggcggcatcctccaccgctccggcagctcaagctccagctcgtcgtctgaggacgacgggatgggagggaggaggaagaagggaatcaaggagaagatcaaggagaagctgcccggcggcaacaagggcaacaaccaccagcagcagcagatgatggggaacactggcggcgcgtacgggcagcagggccacgccgggatgaccggcgccggcaccggcgtgcacggtgcggagtacggcaacgccggcgagaagaagggattcatggacaagatcaaggagaagctgcccggccagcactaa

SEQ ID NO: 52 - protein, 164 aa, Oryza sativa
MDNYQGQHGYGADRVDVYGNPVGAGQYGGGATAPGGGHGAMGMGGHAGAGAGGQFQPAREDHKTGGILHRSGSSSSSSSSEDDGMGGRRKKGIKEKIKEKLPGGNKGNNHQQQQMMGNTGGAYGQQGHAGMTGAGTGVHGAEYGNAGEKKGFMDKIKEKLPGQH

SEQ ID NO: 53 - DNA, 1353 bp, Oryza sativa
  CDS (1)..(1353)
atggcgttcgtctcctgcctctcgccgctgatgctgatgctgatgacgctgatgctgtccgcggcggccgccggtagcggtggtggtggcgtggcggagtacgaggcgcagttcgaggcgtggtgcgcggagcacgggaggtcgtacgcgacgcctggggagcgcgcggcgcggctcgcggcgttcgcggacaacgcggcgttcgtggcggcgcacaacggcgcgcccgcgtcgtacgccctggcgctcaacgccttcgcggacctcacgcacgacgagttccgcgccgcgcgcctcggccgcctcgccgccgccggcggccctggccgggacggcggcgcgccgtacctgggcgtcgacggtggcgtcggggccgtgcccgatgcggtggactggaggcagagcggcgccgtcaccaaggtcaaggaccaaggcagctgcggtgcttgttggagcttctcagctacaggtgccatggagggaataaacaagatcaagacaggttctctgatcagcctttccgaacaggaactaatagactgtgatagatcctacaatagtggttgtggtggtgggctcatggattatgcttataagtttgtggttaaaaatggtggaattgacacggaagcggattacccatatcgtgaaacagatggaacatgtaacaagaacaagctcaaaaggcgagtggtaacaattgatggctacaaagatgtgcctgccaacaatgaagatatgttacttcaggctgttgctcagcaacctgttagtgtaggaatatgcggtagcgctagagcatttcagttgtactccaagggtatcttcgatggtccatgtcctacatctcttgatcatgctatattaattgtgggatatggttctgaaggtggcaaggattactggattgtgaaaaattcttggggtgaaagttggggtatgaaaggctatatgtatatgcatcgaaacactggtaactccaatggtgtctgtggcataaaccagatgccgtcattccctacgaaatcaagcccgaatcctcctccttcaccagggccaggtccaaccaaatgcagccttcttacctattgccctgaaggatccacctgctgctgctcctggcgtgtcctggggctatgcctttcctggagttgttgtgaactggataacgcagtttgctgcaaggataatcgctattgctgccctcatgactacccggtttgtgatacggccagccaacgatgcttcaaggcaaataatggcaacttctctgtcatggagggagggagtaggaaacaacctttctccaaagttccttctttgggtggtttgttggaactgttggatcagtga

SEQ ID NO: 54 - protein, 450 aa, Oryza sativa
MAFVSCLSPLMLMLMTLMLSAAAAGSGGGGVAEYEAQFEAWCAEHGRSYATPGERAARLAAFADNAAFVAAHNGAPASYALALNAFADLTHDEFRAARLGRLAAAGGPGRDGGAPYLGVDGGVGAVPDAVDWRQSGAVTKVKDQGSCGACWSFSATGAMEGINKIKTGSLISLSEQELIDCDRSYNSGCGGGLMDYAYKFVVKNGGIDTEADYPYRETDGTCNKNKLKRRVVTIDGYKDVPANNEDMLLQAVAQQPVSVGICGSARAFQLYSKGIFDGPCPTSLDHAILIVGYGSEGGKDYWIVKNSWGESWGMKGYMYMHRNTGNSNGVCGINQMPSFPTKSSPNPPPSPGPGPTKCSLLTYCPEGSTCCCSWRVLGLCLSWSCCELDNAVCCKDNRYCCPHDYPVCDTASQRCFKANNGNFSVMEGGSRKQPFSKVPSLGGLLELLDQ

SEQ ID NO: 55 - DNA, 432 bp, Oryza sativa
  CDS (1)..(432)
atggagaaagagagggagatcctctcacatttccatcaagaaatgaccgggctacagcaatttgaaacaaacaaccacagaccacgggaacatgcaaacatctggcgccatcccaacaaaaggctgagacaagtttttgagtatggcagcgaaggcatctgcagtgttcgtcctgctggtggtggtgctcgcggtggccgcggcgatgcggggagcggaggcggcgacgtgcacgccgacgcagctgacgccgtgcgcgccggcgatcgtggggaactgccgccgacggcggcgtgctgcgggaagctgaaggcgcacccggcgagctgcttctgccagtacaagaaggacccgaacatgaagaagtacgtcaactcgcccaacggcaagaaggtcttcgccacctgcaaggttcccctgcccaaatgctaa

SEQ ID NO: 56 - protein, 143 aa, Oryza sativa
MEKEREILSHFHQEMTGLQQFETNNHRPREHANIWRHPNKRLRQVFEYGSEGICSVRPAGGGARGGRGDAGSGGGDVHADAADAVRAGDRGELPPTAACCGKLKAHPASCFCQYKKDPNMKKYVNSPNGKKVFATCKVPLPKC

SEQ ID NO: 57 - DNA, 1140 bp, Oryza sativa
  CDS (1)..(1140)
atggcgaccgcagggaaggtgatcaagtgcaaagcggcggtggcatgggaggccgcgaagccgctggtgatcgaggaggtggaggtggcgccgccgcaggccatggaggtgcgcgtcaagatcctcttcacctcgctctgccacaccgacgtctacttctgggaggccaagggacagactcccgtgttccctcggatcttcggccatgaagctggaggtattgtggagagtgttggagagggtgtgactgatcttgcccctggtgaccatgttctccctgtgttcactggggagtgcaaggagtgtgcccactgcaagtcagcagagagcaacatgtgtgatctgctcaggatcaacactgacaggggtgtgatgattggtgatggcaaatcacgcttttccatcaacgggaagcccatttaccatttcgtcgggacttcgaccttcagcgagtacactgtcatgcatgttggttgcgttgcgaagatcaacccggcagctccacttgataaagtttgcgttcttagctgtggtatttctactggtcttggtgctacaatcaatgtggcaaagccaccaaagggttcgacggtggcgatatttggtctaggagctgtaggccttgctgccgcagaaggtgcaaggattgcaggagcgtcaaggatcattggcattgacctgaacgccaacagatttgaagaagctaggaaatttggttgcactgaatttgtgaacccaaaggaccatgacaagccagttcagcaggtacttgctgagatgaccaatggcggagttgaccgcagcgttgaatgcactggcaacatcaacgccatgatccaagcatttgaatgtgttcatgatggctggggtgttgctgttttggtcggcgtgccacacaaggacgccgagttcaagacccacccgatgaacttcctgaacgagaggactctcaagggaaccttcttcggcaactacaagccacgcaccgatctgcccaacgtcgtcgagctctacatgaagaaggagctggaggtggagaagttcatcacacacagcgtgccgttctcggagatcaacacggcgttcgacctgatgcacaagggcgagggcatccgctgcatcatccgcatggagaactga

SEQ ID NO: 58 - protein, 379 aa, Oryza sativa
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 59 - DNA, 756 bp, Oryza sativa
  CDS (1)..(756)
atgtcctctagcgatcagaacccatcgccaacaccggcgtccggcaccggcacgtccgtgccgccgccaggcagggcgacgacggtatcctcgcagctcctggacatgggcgcgcaagcggtgcaggcgctgaagcccgtgcgccagatgaagcagcacgcgtgcagcttcgcgctgtacgctcacgacctgagccgccaggtcgaggtccaccacttcgtctcccgcctcaaccaggacgtcctccagtgcgccgtctacgactccgacaagccctcggcccgcctcatcggtggcgtggagtacatcgtgtcggacgccatcttcgagagcctgcctccggaggagcagaagctgtggcactcgcacgcgtacgaggtgaaggccgggctgtggaccgacgtcggcgtgccggagccgctgcagagctcggagatggcgaggatggccaagacgtacggcaagctctggtgcacctggcaggtggaccgcggcgacgcgctgcccctgggcgcgccggcgctcatggtgtcgccgcaggccgtggagcccgggcgggtgcgcgccgagctcgtgcacggccgcgacgagaggtacaagatcgacagctcggcgcaggggctgaagggggccagggttgagatggacgagccggagtggatcaacccgaacgccgactactggcgcctacacggcaaggggttcgccatcgacgtcaccgccaccgagatgaagcgccacgcgcccttcccgtga

SEQ ID NO: 60 - protein, 251 aa, Oryza sativa
MSSSDQNPSPTPASGTGTSVPPPGRATTVSSQLLDMGAQAVQALKPVRQMKQHACSFALYAHDLSRQVEVHHFVSRLNQDVLQCAVYDSDKPSARLIGGVEYIVSDAIFESLPPEEQKLWHSHAYEVKAGLWTDVGVPEPLQSSEMARMAKTYGKLWCTWQVDRGDALPLGAPALMVSPQAVEPGRVRAELVHGRDERYKIDSSAQGLKGARVEMDEPEWINPNADYWRLHGKGFAIDVTATEMKRHAPFP

SEQ ID NO: 61 - DNA, 354 bp, Oryza sativa
  CDS (1)..(354)
atggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccagcagggtgagctga

SEQ ID NO: 62 - protein, 117 aa, Oryza sativa
MARAQLVLVAVVAALLLAAPHAAVAITCGQVNSAVGPCLTYARGGAGPSAACCSGVRSLKAAASSTADRRTACNCLKNAARGIKGLNAGNAASIPSKCGVSVPYTISASIDCSSRVS

SEQ ID NO: 63 - DNA, 1173 bp, Oryza sativa
  CDS (1)..(1173)
atgggctcctacgctttgccacggcggtctctcgtcctcttcctcctctccgccgccgccgtcgcgtcgacggcagcatgggctgccgcttcgtcggcggccggcggtggtgatgatgccgctcgccgcagcctcctcgacaacgggctcgggcggacgccgcagatggggtggaacagttggaatcatttcgggtgcaacatcaacgagaacaccatccggagcaccgtcggaggttacatagctgctgatccaaagaagttcccttcggggattaaggcactcgcagattatgtgcacagcaaggggcttaaactaggcatatactcttcagccggctcaagaacttgcagcaaaacgatgcccggatctctgggctacgaggacatcgatgctaagacatttgcatcatggggtgtggattacttgaagtacgacaactgcaacagtgacggctcgagcgaaaccgtcagattccccaagatgtctttcgctctgagaaaaaccggacgtccgatcttctactcgatctgcgaatggggccagaggaatgtggcgacgtggggtggccagtacggcaacagctggaggaccaccggcgacatcaatgactcatgggccagcatgctgagcaacatcgacagcaacgacgcctccgccagctacgccaagcccggcggctggaacgatcctgacatgctggaggtcggcaatggagggatgacgaacgacgagtacgtcgtgcacatcagcctttgggcgattgccaaggctcctctgatcatcgggtgcgacgtgaggagtatctccagggagacgatggagatcctctccaaccctgaagtcatcgccattaaccaagatccattgggcgtccagggaaagaaagtcaggaagtacgacaacgaaatcgaggtatgggcagggccgctctcccagcagaggacggcggtgctgctgctgaaccgcggcgccacgggcagccggcagatcacggcggcgtggcaggacatcggcgtcggccccggcgtcgccgtcgaggcgaagaacgtctggctgcacgcgacggcgccggggaggttcaccggcagcctgacggcggaggtggcggcgcactcgtgcaagctcttcgtcctcacgcccgtcggccgggccagcgaggagcggagctag

SEQ ID NO: 64 - protein, 390 aa, Oryza sativa
MGSYALPRRSLVLFLLSAAAVASTAAWAAASSAAGGGDDAARRSLLDNGLGRTPQMGWNSWNHFGCNINENTIRSTVGGYIAADPKKFPSGIKALADYVHSKGLKLGIYSSAGSRTCSKTMPGSLGYEDIDAKTFASWGVDYLKYDNCNSDGSSETVRFPKMSFALRKTGRPIFYSICEWGQRNVATWGGQYGNSWRTTGDINDSWASMLSNIDSNDASASYAKPGGWNDPDMLEVGNGGMTNDEYVVHISLWAIAKAPLIIGCDVRSISRETMEILSNPEVIAINQDPLGVQGKKVRKYDNEIEVWAGPLSQQRTAVLLLNRGATGSRQITAAWQDIGVGPGVAVEAKNVWLHATAPGRFTGSLTAEVAAHSCKLFVLTPVGRASEERS

SEQ ID NO: 65 - DNA, 1989 bp, Oryza sativa
  CDS (1)..(1989)
atggcggcggcggcggcgcaggcgcaagcgcagcaggcggcgagctccgcgtccgagggcgggtccccggcctcctccgccgcggccgctgcggcggcggccgcctccttcccggggacctcgctttacgtcggggatctcgacgtcagcgtgcaggacgcgcagctcttcgacgtcttcgcgcaggtcggcggcgtcgtctccgtgcgcgtctgcagggacgtcaacacgcggaggtcgctcggctacgcctacgtcaactacagcagccccgccgatgctgcacgagcgttggaaatgctcaacttcactcctatcaatggaaaacctatcaggatcatgtattctaaccgtgaccccagcttgcgcaagagtggcacagcaaatatttttatcaagaaccttgataagtcgatagacaacaaagctttgtatgatactttctgtgtgtttggaaacattctttcatgtaaagttgcaacagatgcttctggagaatcgaagggctatggctttgttcagtatgagcgggatgaggcagctcaagctgctattgataaactcaatggcatgcttatgaatgacaaaaaggtgtatgttgggcctttcattcgtaagcaggagagggataattctccaggccaggtcaagttcaataatgtctatgtaaagaacctgtctgagaatactactgaagatgacttgaaggaaatctttggaaaatttggaaccatcactagcgctgttgtaatgcgtgagggagatggaagatccaagtgttttggatttgttaactttgaaagtccagatgatgctgctcaggctgtccaagagctgaatggcaagaagtttgatgataaggaatggtatgttggaagggcacaaaagaaatcggaaagagagatggaattgaaagagaaatttgagaagaaccttcaagaagcagcagataagtatcaaaacactaacctgtacctgaagaacttggatgatagtgttgatgatgataagttgagggagctttttgctgagtatggcactattacttcctgcaaggtgatgcgggattcaaatggtgtcagcagaggttctggatttgttgcgtttaaatctgctgaagatgcttcccgagctcttgccgaaatgaacagcaagatggttggcagcaaaccgctctacgttgcgcttgcacagcgcaaggaagacaggaaagcaaggctgcaggcacaattttcacaactgaggcctgtcccacttgctccttcagttggtcctcgcatgcccatgtttccacctggtgttcctggagttggacagcaactgttctatggtcagccccctccagcgtttatcaacacacagcctggtttcggcttccagcagcctcttatgcctgggatgaggccaggtgcaggtccaatgccgaactttatcatgcctatggttcagcaaggacaacagccgcagcgtccggctggtaggcgtgctggtgctggtggaatgcagcaacccatgccaatgggtcagcaacagatgatggctaggggcggccgtggctatcggtatcctacaggacgtggcatgcctgatcctgcaatgcatggtgttgggggtggtgtgatgccatctccatatgagatgggaggcatgcccatgagagatgctgctgcgtcacagcctgtacctattggagcattggctactgcactggccaacgcagcccctgatcagcaaagaatgatgcttggtgagaacttgtatcctcttgttgatcagctggagcatgagcaggctgcgaaggtgactggcatgctgctggagatggaccagactgaggtgctgcacctgctcgagtctccagaggctctcaaggccaaggttgctgaagccatggaggtccttcgcacggcccagcagatccagacgaacgcgacgcctgaacagcagcttgcttctctgtcgctgaatgacggcgtcgtttcctcctaa

SEQ ID NO: 66 - protein, 662 aa, Oryza sativa
MAAAAAQAQAQQAASSASEGGSPASSAAAAAAAAASFPGTSLYVGDLDVSVQDAQLFDVFAQVGGVVSVRVCRDVNTRRSLGYAYVNYSSPADAARALEMLNFTPINGKPIRIMYSNRDPSLRKSGTANIFIKNLDKSIDNKALYDTFCVFGNILSCKVATDASGESKGYGFVQYERDEAAQAAIDKLNGMLMNDKKVYVGPFIRKQERDNSPGQVKFNNVYVKNLSENTTEDDLKEIFGKFGTITSAVVMREGDGRSKCFGFVNFESPDDAAQAVQELNGKKFDDKEWYVGRAQKKSEREMELKEKFEKNLQEAADKYQNTNLYLKNLDDSVDDDKLRELFAEYGTITSCKVMRDSNGVSRGSGFVAFKSAEDASRALAEMNSKMVGSKPLYVALAQRKEDRKARLQAQFSQLRPVPLAPSVGPRMPMFPPGVPGVGQQLFYGQPPPAFINTQPGFGFQQPLMPGMRPGAGPMPNFIMPMVQQGQQPQRPAGRRAGAGGMQQPMPMGQQQMMARGGRGYRYPTGRGMPDPAMHGVGGGVMPSPYEMGGMPMRDAAASQPVPIGALATALANAAPDQQRMMLGENLYPLVDQLEHEQAAKVTGMLLEMDQTEVLHLLESPEALKAKVAEAMEVLRTAQQIQTNATPEQQLASLSLNDGVVSS

SEQ ID NO: 67 - DNA, 969 bp, Oryza sativa
  CDS (1)..(969)
atgggctcgctgagaggaggcggcggcggcggcggaggaggaagaggagattgcagtaagcaggaggagacggagagggtgatgaggagcgtggacgcggaggaggcgtgcgcgctgctgagctcggggaggcaccaatacctggacgtgaggatgtgggaggactttgacaagggccacgtcgccggcgcccgcaacgtgccctactacctctccgtgacgccgcgcgccaaggagaagaacccgcacttcgtccagcaggtggccgccctctaccacgcccacgaccacatcatcgtcggttgccgctccggcgtccggtccaagctcgccacggcagaccttgtcgccgcggtatgtacgcccctgccttgccttgatctacaaatttctcagctattcagtgaaggaattgaattgaatatatgcgcacgcagggattcaagaacgctcgctactccttccacaaggttcactatttccgctgcgaaccattttgtggaagaagtgacaagcccgtacgggagtagcggtggcgactcccatcttctctcccggcgtggtggccatttggagctcagggaccacccctatctaaccgcacggagctcatgggccgtcaggtctagcggccatgctggatccggccaggtgcaagtgcgatggctactccaccatgccaatgacaacgaacccgtttttagggtgtttgatttggagataagtggaatggcagtatggatggctagtttccctaacggaggggcgtcgatgatgcttccccttgctgtggctgaggcggtgggagagaggagacaaggcaacggcggtggaagagccaaccaaaagatgctctcatggcacaggcagctcgggttcatcctagccgccgcgctccaccatgctgctcaatgcgtcctccttcatcggccatccctcctaggccatcatctagctccactcaattag

SEQ ID NO: 68 - protein, 322 aa, Oryza sativa
MGSLRGGGGGGGGGRGDCSKQEETERVMRSVDAEEACALLSSGRHQYLDVRMWEDFDKGHVAGARNVPYYLSVTPRAKEKNPHFVQQVAALYHAHDHIIVGCRSGVRSKLATADLVAAVCTPLPCLDLQISQLFSEGIELNICARRDSRTLATPSTRFTISAANHFVEEVTSPYGSSGGDSHLLSRRGGHLELRDHPYLTARSSWAVRSSGHAGSGQVQVRWLLHHANDNEPVFRVFDLEISGMAVWMASFPNGGASMMLPLAVAEAVGERRQGNGGGRANQKMLSWHRQLGFILAAALHHAAQCVLLHRPSLLGHHLAPLN

SEQ ID NO: 69 - DNA, 546 bp, Oryza sativa
  CDS (1)..(546)
atggtaagcgacgcctctctcctcgcccccggattcctccctccctcgcttgctctcgccgacgctgctcgattcgagcctgaccgcccgcctgttcgttcgctcgttctggttgctgtgcagagccaggaggtcgtgaaccctaaggcctacccgctggcggacgcgcagctgacgatgaccatcctcgacctcgtccagcaggcctccaattacaagcagctcaagaagggggccaacgaagcgacgaagaccctgaacaggggtatatcagagttcgtggtgatggcggccgacacggagccgctcgagatccttctccacctccccctgctcgcggaggataagaacgttccatatgtttttgtcccttcgaagcaagcccttggccgcgcatgtggcgttactagacctgtcattgcttgttcagtgaccagcaacgagggcagtcagctgaagacaccgatacagaatctcaaggtaaccatacctttggatcatctagtactttgctggaaaactgtgagactgttatctctattttag

SEQ ID NO: 70 - protein, 181 aa, Oryza sativa
MVSDASLLAPGFLPPSLALADAARFEPDRPPVRSLVLVAVQSQEVVNPKAYPLADAQLTMTILDLVQQASNYKQLKKGANEATKTLNRGISEFVVMAADTEPLEILLHLPLLAEDKNVPYVFVPSKQALGRACGVTRPVIACSVTSNEGSQLKTPIQNLKVTIPLDHLVLCWKTVRLLSLF

SEQ ID NO: 71 - DNA, 621 bp, Oryza sativa
  CDS (1)..(621)
atggcggagaacccgcagctgttcgggaacgggatgctggtgcccttctacggcgagatgttcgtcctcgcccgcgacggcgtcgagttccacgtcgacaagatcccctcagctcctggtggtcatgcgaaaacaaagggcacaatttacctgtcaaacataaggatggtctttgtcgccagcaagcctgttgggaacttctttgcttttgatatgcccctgttgtatgtgcatggtgagaaattcaatcagccaatatttcactgcaacaacatatcgggtttcgttgagccggttgtaccagagaaccagaacagggccctgtactcgacccacactttcaagatcttgttcaaggagggtggctgtggtacctttgttcctctcttcctaaacctggttgcatctgtgcgacgctacaatcagtttgaggcccagtctgccgcaagtatggcgccacgtgtggacccgctacaagctgttcagactcctgttgatgatatgatgcgtcatgcgtatgttgatccgaacgatcctacaaagattttccttcagcagcctgcgccagagtcacagctgaggaggagaaactaccacggacgggctgacaatgcgtactag

SEQ ID NO: 72 - protein, 206 aa, Oryza sativa
MAENPQLFGNGMLVPFYGEMFVLARDGVEFHVDKIPSAPGGHAKTKGTIYLSNIRMVFVASKPVGNFFAFDMPLLYVHGEKFNQPIFHCNNISGFVEPVVPENQNRALYSTHTFKILFKEGGCGTFVPLFLNLVASVRRYNQFEAQSAASMAPRVDPLQAVQTPVDDMMRHAYVDPNDPTKIFLQQPAPESQLRRRNYHGRADNAY

SEQ ID NO: 73 - DNA, 498 bp, Oryza sativa
  CDS (1)..(498)
atggagaacgtcaccggaggaggaggaggaggatcgccgcggcgggtggtggtggcggtggacgagagcgaggagagcatgcacgcgctgtcgtggtgcctctccaacgtggtctccgtcctggtccacgcccggccggcgcggccgctctactacccggtgatcgacggcggcggctacgtgctgacccaggaggtgatggacagcatggaccgctacatggccaccgccgccgactccgtcgtcgccaaggcccgcgacatctgcaccgccttccccaatgtgaaggtggagacgcgggtggagaaaggggacccgagggatgtgatctgcggggcggtggagaaggccggcgcggacatggtggtgatggggagccatggttacggtttcctgcagaggacgctgctggggagcgtcagcaaccactgcgtccagcactgcaagtgccccgtcgtcgtcgtcaagaggcccggcaccaacgccaaggcctcttga

SEQ ID NO: 74 - protein, 165 aa, Oryza sativa
MENVTGGGGGGSPRRVVVAVDESEESMHALSWCLSNVVSVLVHARPARPLYYPVIDGGGYVLTQEVMDSMDRYMATAADSVVAKARDICTAFPNVKVETRVEKGDPRDVICGAVEKAGADMVVMGSHGYGFLQRTLLGSVSNHCVQHCKCPVVVVKRPGTNAKAS

SEQ ID NO: 75 - DNA, 558 bp, Oryza sativa
  CDS (1)..(558)
atggctactactaagcatttggctcttgccatccttgtcctccttagcattggtatgaccaccagtgcaagaaccctcctaggttatggccccggaggaggaggtggaggtggtggtggtggtgaaggaggcggtggtggttacggtggatcgggctatggttctggttctgggtatggtgagggaggtggtagtggaggtgctgccggtggcgggtatgggcgtggtggaggcggcggcggcggtggtggtgagggtggtggctccggctctggctatgggtctgggcaaggctctggctatggtgcaggtgttggtggtgctggcgggtatggtagtggtggcggaggtggtggtggccaaggtggtggtgctggcggctacgggcaagggtctggctatggttccggctatgggtcgggtgctggtggtgctcatggtggtggttatggaagtggtggcggtggcggtggcggtggaggccaaggtggaggctccggctctggctctggctctggatatggctctggctctggcggaggcaacggacaccactaa

SEQ ID NO: 76 - protein, 185 aa, Oryza sativa
MATTKHLALAILVLLSIGMTTSARTLLGYGPGGGGGGGGGGEGGGGGYGGSGYGSGSGYGEGGGSGGAAGGGYGRGGGGGGGGGEGGGSGSGYGSGQGSGYGAGVGGAGGYGSGGGGGGGQGGGAGGYGQGSGYGSGYGSGAGGAHGGGYGSGGGGGGGGGQGGGSGSGSGSGYGSGSGGGNGHH

SEQ ID NO: 77 - DNA, 1221 bp, Oryza sativa
  CDS (1)..(1221)
atggcccaccgccgcatcatcctcctcctcgccgccgccgccgtcgccgcgacctccgccgtcgccgccgcgtcctccggcttcgacgactccaacccgatccgctccgtcacggaccacgccgcctccgcgctcgagtcaaccgtcatcgccgccctcggccgcacccgcgacgccctccgcttcgcccgcttcgccgtcaggcatgggaagaggtacggcgacgcggcggaggtgcagcggcggttccggatcttctccgagagcctcgagctcgtccgctccaccaaccggaggggcctcccctaccgcctcggcatcaaccgtaggacctcgagccgagcgcctcctaatcctcctaatcctcctctcacacacccccgtcgcggtgcttttgcaggtttcgcggacatgagctgggaggagttccaggcgagccggctcggcgcggcgcagaactgctcggcgacgctcgccggcaaccaccggatgcgcgacgccgccgctctcccggagaccttactgcagaaagactggagggaggatgggatcgtgagccccgtgaaagaccagggtcactgtggttcctgttggaccttcagatcagtatgtcggttaagctggagattgctaactctcgagtacagtagcaccactggttctcttgaggcagcatatactcaggccactgggaagcctgtctctctttctgagcagcagctggttgattgtgctactgcatacaataatttcggatgcagtggaggcctaccatctcaggcctttgagtacatcaaatacaatggtggccttgacactgaagaggcttacccttacacgggtgtcaatggcatctgtcattacaagcctgaaaacgttggagtcaaggttttggactccgttaacatcaccctgggtgctgaggatgagctgaagaatgctgttggacttgttcgtccagttagtgttgcctttcaggtgatcaacggtttcaggatgtacaagagtggagtttacacaagtgaccattgtggaacttctccaatggatgtgaaccacgctgttctggccgttggctatggtgtcgaaaatggcgttccctactggctcatcaagaactcatggggtgcagactggggtgacaatggttacttcaagatggaaatgggcaagaacatgtgcggtattgctacttgcgcatcctaccctattgttgcatga

SEQ ID NO: 78 - protein, 406 aa, Oryza sativa
MAHRRIILLLAAAAVAATSAVAAASSGFDDSNPIRSVTDHAASALESTVIAALGRTRDALRFARFAVRHGKRYGDAAEVQRRFRIFSESLELVRSTNRRGLPYRLGINRRTSSRAPPNPPNPPLTHPRRGAFAGFADMSWEEFQASRLGAAQNCSATLAGNHRMRDAAALPETLLQKDWREDGIVSPVKDQGHCGSCWTFRSVCRLSWRLLTLEYSSTTGSLEAAYTQATGKPVSLSEQQLVDCATAYNNFGCSGGLPSQAFEYIKYNGGLDTEEAYPYTGVNGICHYKPENVGVKVLDSVNITLGAEDELKNAVGLVRPVSVAFQVINGFRMYKSGVYTSDHCGTSPMDVNHAVLAVGYGVENGVPYWLIKNSWGADWGDNGYFKMEMGKNMCGIATCASYPIVA

SEQ ID NO: 79 - DNA, 342 bp, Oryza sativa
  CDS (1)..(342)
atgtcgagcccggatcaaggtgcacgcacgctccgggggaagaacaaggcggagctgcaggcccagctcaaggacctcaaggcggagctctccctcctccgcgtcgccaagaaggtggtgcgcacctcgatcgcgcgcgtgctggtgatctcgcagaagcagaaggcggcgctgagggaggcgtacaagaagaagagcctgctcccgctcgacctccgccccaagaagacccgcgccatccgcaggcgcctcaccaagcaccagcagctctctttgaagaccgagagggagaagaagcgtgagaagtatttccccatgaggaagtatgctgttaaagcttag

SEQ ID NO: 80 - protein, 113 aa, Oryza sativa
MSSPDQGARTLRGKNKAELQAQLKDLKAELSLLRVAKKVVRTSIARVLVISQKQKAALREAYKKKSLLPLDLRPKKTRAIRRRLTKHQQLSLKTEREKKREKYFPMRKYAVKA

SEQ ID NO: 81 - DNA, 1242 bp, Oryza sativa
  CDS (1)..(1242)
atggaggcagcagcagcagccgccgcggcgctcttgtcgccgcccgccgccgccgcgccctcgcggcggcctgggactcccggtgctacctcgctccccttcgcccggaggcgcggtgtcgccgccgtcaagggtcttggacggcagcagctcacctgcagaaggcgaggcgtcgtcgtgagggcggcgtcgtggtcgccgtcggggccggagtcgctgccgccgccgccgtcgtcgtcgatcgcgccgctccagatggagtcgccggtggggcagttcctctcgcagatcctggccacgcacccgcacctgcttcccgccgccgccgagcagcagctcgagcagctccagaccgaccgcgacgccgccaaggacaacggcggcgacaagcccgcgccgtcggacggcgacatcgtgctgtacaggcggattgctgaggtcaaggaaaaggagcgcaagagggctttggaggagatactctatgcacttgttgtccagaagtttgttgaagctggtgtttctttggttccagctctttcccactctatcagttcttctggaagagttgatcagtgggcagaatctgtggaagggaaacttgagaagatgcattcacaggaggcatatgaaatgatcgagaaccacctcgctctcatcctggggcagcggcaagctgatgccactgttgcggccataagtaaactccgagttggtcaggtgtatgctgcttctgtgatgtatggttacttccttaagagagtcgatcagagatttcagctcgagaagtcaatgaagaccctcccttggggatcagaagaggaagacaagctcaaccaagttatgacaacggactcaaggccctcaccccagacttctacttcacatccagagatggcatcatggacttcccctaacttcagtgcaggcggacctagccaatctgttaagccatgccgtcttagatcgtatgtcatgtcatttgattcagagaccctacaaagttacgcaacaatcaggtccaaggaggcatttggcatcatcgagaagcacactgaggcactatttggtaaaccagagattgtaatcacacctgaaggcacagtcgattcttccaaggatgaacatgtcaggataagtttcgcagggttgagaaggctgatcttagaggctgttacttttggatccttcctttgggatgttgagagctttgtggacaccaggtaccattttgtggccaactag

SEQ ID NO: 82 - protein, 413 aa, Oryza sativa
MEAAAAAAAALLSPPAAAAPSRRPGTPGATSLPFARRRGVAAVKGLGRQQLTCRRRGVVVRAASWSPSGPESLPPPPSSSIAPLQMESPVGQFLSQILATHPHLLPAAAEQQLEQLQTDRDAAKDNGGDKPAPSDGDIVLYRRIAEVKEKERKRALEEILYALVVQKFVEAGVSLVPALSHSISSSGRVDQWAESVEGKLEKMHSQEAYEMIENHLALILGQRQADATVAAISKLRVGQVYAASVMYGYFLKRVDQRFQLEKSMKTLPWGSEEEDKLNQVMTTDSRPSPQTSTSHPEMASWTSPNFSAGGPSQSVKPCRLRSYVMSFDSETLQSYATIRSKEAFGIIEKHTEALFGKPEIVITPEGTVDSSKDEHVRISFAGLRRLILEAVTFGSFLWDVESFVDTRYHFVAN

SEQ ID NO: 83 - DNA, 759 bp, Oryza sativa
  CDS (1)..(759)
atgtcgtcggtgcagctctccggtgccggagtcgccgcggtggccttcaccaagaatggcgcgtcttccttcgacgggctccgcctcgcgccgccatctgtgcgagtctgctcctccaggcgcccgtctcgtagcctcgtcgtcaaggccgccacggtcgtcaccccaaagtatacctcgctcaagcctctgggagacagagtgcttgtgaagcttggtgctgcagaggagaagactgttggtgggattctgcttccgtcaaccgcacagtctaagcctcagggaggtgaggttgttgctgttggagagggaagaactattggggataagaaagttgaggtcagcttgcagattggggctgaagttgtatattcaaaatatgctgggactgaggtgcaatttaacgacaccaaacatcttattctaaaagaggatgatatcattggtgttcttgagactgatgatgtcaaagatatgaagccccttaatgaccgggttctcatcaaggttgctgaggctgaagacaaaactgctggtggccttattctcactgaaaccactaaggagaagccatcaatcggaacagttgtagccgttggtccaggccctcttgatgatgaaggcaagaggcagccattgtcagtttcagcgggcagcactgtgatgtactccaagtacgcaggcagtgagttcaagggagctgatggcaccaactacattgtcttgagagtatcagatgtgatggctgtcctatcttga

SEQ ID NO: 84 - protein, 252 aa, Oryza sativa
MSSVQLSGAGVAAVAFTKNGASSFDGLRLAPPSVRVCSSRRPSRSLVVKAATVVTPKYTSLKPLGDRVLVKLGAAEEKTVGGILLPSTAQSKPQGGEVVAVGEGRTIGDKKVEVSLQIGAEVVYSKYAGTEVQFNDTKHLILKEDDIIGVLETDDVKDMKPLNDRVLIKVAEAEDKTAGGLILTETTKEKPSIGTVVAVGPGPLDDEGKRQPLSVSAGSTVMYSKYAGSEFKGADGTNYIVLRVSDVMAVLS

SEQ ID NO: 85 - DNA, 930 bp, Oryza sativa
  CDS (1)..(930)
atggcgtcggtgcagctgtccgccggcccgcgggtgtcagtgtcaccggcggcggcgctggtggcgatgccttcggtcgccgccgccgcatcgagggggcgccgcgggtaccgggggctcgtcgtgagggccgccacggtcgtgtcgcccaaggtgaggcacagctgcaccccactcttattcgggagacctgtgacgtctatggtgttttgggtttctgtgcgtgcgttgctactgcttgcgagtgtggaagcgctctcaaagctcgcggtggcgcttgaagggattaggagatcatttcgttttgttttcaattgcagagcaattatcgtactggattggctgtatacttctatcaaacccttgggagatagggtgcttgtgaagatcaagacctctgatgataaaactgttggaggaatattacttccaacatcagttcagtcaaaaccgcaaggaggacaagttgtagcagttggagaggggagaagcatgggcagcgacagcatagagatcagtgttccagttggtgcacaagttgtctactctaaatatgctggcacagagttggaattcgatgggtctgaccatctcattttgaaagaagatgacatcattggtattctcgacacagatgatgtgaaagatctgaagccactgaatgaccgtgttctcattaaggttgcagaggctgaagagaaaactgcaggtggtttgctattgacacaagcgaccaaagaaaagccttctattggaacagtgacagccgtaggcccaggaccattggttgaggatggcagcaggaaacccttgtcaatcactcctgggaataccgtgatgtactccaagtacgcgggaagcgagtttaagggtgaagatggcgaatatattgttctcagggtatccgacgtaatggctgttctttcctaa

SEQ ID NO: 86 - protein, 309 aa, Oryza sativa
MASVQLSAGPRVSVSPAAALVAMPSVAAAASRGRRGYRGLVVRAATVVSPKVRHSCTPLLFGRPVTSMVFWVSVRALLLLASVEALSKLAVALEGIRRSFRFVFNCRAIIVLDWLYTSIKPLGDRVLVKIKTSDDKTVGGILLPTSVQSKPQGGQVVAVGEGRSMGSDSIEISVPVGAQVVYSKYAGTELEFDGSDHLILKEDDIIGILDTDDVKDLKPLNDRVLIKVAEAEEKTAGGLLLTQATKEKPSIGTVTAVGPGPLVEDGSRKPLSITPGNTVMYSKYAGSEFKGEDGEYIVLRVSDVMAVLS

SEQ ID NO: 87 - DNA, 339 bp, Oryza sativa
  CDS (1)..(339)
atggcgccgccgcagcccaagtcggggctcttcgtcggcatcaacaagggccacgtcgtcaccaagcgcgagctgccacctcgcccgtccgaccgcaaggggtttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggcgggtgtcatcaggaagatgaggtgtgtgtctttactactgcattctgcaatttcattgttgatgttctctgttttttag

SEQ ID NO: 88 - protein, 112 aa, Oryza sativa
MAPPQPKSGLFVGINKGHVVTKRELPPRPSDRKGFVRGLIREVVGFAPYEKRITELLKVGKDKRALKVAKRKLGTHKRAKKKREEMAGVIRKMRCVSLLLHSAISLLMFSVF

SEQ ID NO: 89 - DNA, 897 bp, Oryza sativa
  CDS (1)..(897)
atggacggcaaggactccaccaccacccccgcccctgccccggctccggctccggctccggcgccggcggcagagcctcagacgacggggaacgcgccgccgccgccgccgcagcagcagcagcagcagccggaggcggcgaagtgggggacgaggcagatgggcccgccggcggcgcccggggcgcacccggagaaccagcaggcggcgcggtggacggcggcgaggggcgaccaggagctcccgccctacgtcatcatgggcgaggcggcggcggcgccgccgcgggggcggccggagagaggggacagcccgatggagcacatcctcgacttcttcaacacctggagccgcaaggccgaggagctcgcctccaacatctggttcaacctgaagacggcgccgtcgatgtcggacgcggcgatggggaagctgagcctgggagcgaaggccctcagcgagggcggcttcgacaagctctacaagcagacgttcgccggcgccggcgccgacgagcggctgaggaagacgttcgcctgctacctctcgacggcgacgggccccgtcgccggcacgctgtacctgaccgaccggagcgtcgcgttctgcagcgaccggccgctctccttcgcggcgccctcggggcagacggcgtggagctactacaaggtgatgatcccggtggccaaggtcgccgccgccgagccggtgacgatgaaggagagcccgccggagaagtacgtgcacgtcgtgacggtggactcgcatgacttctggttcatggggttcgttagctatgacaaggccgtgcaccacctcgtccaggccgtctcctcccagcaacgtggcggcgccgccgctgacacggccgccgccgtccccggagacggcaagtga

SEQ ID NO: 90 - protein, 298 aa, Oryza sativa
MDGKDSTTTPAPAPAPAPAPAPAAEPQTTGNAPPPPPQQQQQQPEAAKWGTRQMGPPAAPGAHPENQQAARWTAARGDQELPPYVIMGEAAAAPPRGRPERGDSPMEHILDFFNTWSRKAEELASNIWFNLKTAPSMSDAAMGKLSLGAKALSEGGFDKLYKQTFAGAGADERLRKTFACYLSTATGPVAGTLYLTDRSVAFCSDRPLSFAAPSGQTAWSYYKVMIPVAKVAAAEPVTMKESPPEKYVHVVTVDSHDFWFMGFVSYDKAVHHLVQAVSSQQRGGAAADTAAAVPGDGK

SEQ ID NO: 91 - DNA, 624 bp, Oryza sativa
  CDS (1)..(624)
atggggaaggggttcatgtcgtacctggcgatgaagacggacgcggcgggaggggaggcggcgcaggcggcgctgatcgacgccgacctgcaggagctgggcgtggcggcgcggaagctcgccaaccacgcgctcgtcctcggcggcggcctcgggttcggcaccaccttcctcaagtggctcgccttcttcgccgccgtgtacctcctgatattggataggacaaactggaagaccaacatgctgaccgctctcttggtcccttacattttctttacactgcctggtgggctgttctctctgttgaggggagaaattggaaaatggattgcgatcattgctgtcatccttcgtctcttctttcctcgccatttccctgagctgcctggtgctgtgatccttctcattgctgttgccccgaacctgtttgcgagcaccttccgaggcgacttagttggcatcttcatatgcctcatcattggatgctacctgcttcaagagcacatcagggcgtcaggtggattcaggaacgccttcaggaagggcaacggagtgtccaacagcattggcatcctcttgctcttcatctaccctgtctgggccctggtgctgaactttctgtag

SEQ ID NO: 92 - protein, 207 aa, Oryza sativa
MGKGFMSYLAMKTDAAGGEAAQAALIDADLQELGVAARKLANHALVLGGGLGFGTTFLKWLAFFAAVYLLILDRTNWKTNMLTALLVPYIFFTLPGGLFSLLRGEIGKWIAIIAVILRLFFPRHFPELPGAVILLIAVAPNLFASTFRGDLVGIFICLIIGCYLLQEHIRASGGFRNAFRKGNGVSNSIGILLLFIYPVWALVLNFL

SEQ ID NO: 93 - DNA, 675 bp, Oryza sativa
  CDS (1)..(675)
atggcggagttccaggagatggcggcggaggtgccgccgtcgctgaaggcgatcacgctgacccacgtccggtaccgccgcggggacacgctcggcctcttcctcgcctgggtctccctcgtcccggtcttcatcagcctgggcgggttcgtctcccacttcctcttccgccgggagctccagggcatctgcttcgccgcgggcctcctcgcctcccagctcctcaacgagctcatcaagcactccgtcgcgcagtcgcgcccggtctactgcgagctgctcgaggcctgcgactcccacggctggccctccagccactcgcagtacaccttcttcttcgccacctacctctcgctcctcacgctccgccgctccccgtcgagccgggtggtcgcctccctggcctggccgctcgccttcctcaccatgctgtccagggtgtacctcggctaccacaccgtcgcgcaggtatttgccggcgcggtagtaggccttgtgtttggtgcaatctggtattggattgtcaacaccatgcttgttgaatattttccaatgattgaggagagtgcaatagcgaggtggttgtatatgaaggatacttcacacattccagatgtgctcaagtttgaatatgataacgcaagggctgccaggaggaaagttgctactgattga

SEQ ID NO: 94 - protein, 224 aa, Oryza sativa
MAEFQEMAAEVPPSLKAITLTHVRYRRGDTLGLFLAWVSLVPVFISLGGFVSHFLFRRELQGICFAAGLLASQLLNELIKHSVAQSRPVYCELLEACDSHGWPSSHSQYTFFFATYLSLLTLRRSPSSRVVASLAWPLAFLTMLSRVYLGYHTVAQVFAGAVVGLVFGAIWYWIVNTMLVEYFPMIEESAIARWLYMKDTSHIPDVLKFEYDNARAARRKVATD

SEQ ID NO: 95 - DNA, 819 bp, Oryza sativa
  CDS (1)..(819)
atggcggccaacccctcctccccgtcggcgggcggcggcggcgacgtgtcggcgtcctcgccgacgctgccgccggtgcggctcgcggcggcgcaggcggcgtcggcggcggcgatccaccccacctcgccgcggtacttcttctcctcgctcgcgggcaccaacgcctccccgcaccggcgcatcgccatcgccgtcgacctctccgacgagtccgcgtacgccgtccggtgggccgtgcagaactacctccgccccggggacgccgtcgtgctcctccacgtgcggcccacctccgtgctctacggcgccgactggggctccatccccgtctccgtctccgacgacgccgacggggaggtcgcacccgcggcatccgcggaggagctgcagaagaagcgggaggaggacttcgacgccttcacgtccaccaaggcggaggacctggcgcagccgctggtcgacgcgcagatcccctttaagatccacgtcgtcaaggaccacgacatgaaggagcgcctctgcctcgaggccgagcgacttggcttgtccgctatgatcatgggaagccgcggcttcggtgcctcgcggaagggcgggaaggggaggcttgggagtgttagtgattattgcgtgcatcactgtgtctgcccggttgtggttgttcgttaccccgatgatgctgcaggtgccgacggggaggcagcagggccaacagatgagctgcacactgtgcctgaggatgaacctgtgtatcatgatgcacctgatgtgcagaaaggtttgcccttttacattgctcaattcaatcgctattaa

SEQ ID NO: 96 - protein, 272 aa, Oryza sativa
MAANPSSPSAGGGGDVSASSPTLPPVRLAAAQAASAAAIHPTSPRYFFSSLAGTNASPHRRIAIAVDLSDESAYAVRWAVQNYLRPGDAVVLLHVRPTSVLYGADWGSIPVSVSDDADGEVAPAASAEELQKKREEDFDAFTSTKAEDLAQPLVDAQIPFKIHVVKDHDMKERLCLEAERLGLSAMIMGSRGFGASRKGGKGRLGSVSDYCVHHCVCPVVVVRYPDDAAGADGEAAGPTDELHTVPEDEPVYHDAPDVQKGLPFYIAQFNRY

SEQ ID NO: 97 - DNA, 822 bp, Oryza sativa
  CDS (1)..(822)
atggccgtcgtgaaggcggcgcgcccggccttccgcggcgcccacgacggggtcgccttcgccgccaacgccgcgttcctcgccgccggctactccctctgcgccgtcggccccgccgcgctcaccgaccccccgccctcaggtgaagaggaggtggggattgatggttggaacagcatggataattgttatgcatttttgtacatcaaggaggagaggggcaagaagaaacgggtattggtaaaatgtctggtgatcggtgatgtccttgccattgatgtcctggatcttgagtcacagaataaaggcccttataatatccagatcaatgtgaaggatttcttctccgaggagcagccaaagaactatgggaacatgtacaaaaactttgcaggcttaattgagaccatgaactcaaatgcattgagcaaattggatgagaaggatgctggtgctgccaagaaccctgaggttgagactagctcatcaatacacagcttggtttatcctccaatagctccacttggtcatgatgatgccttccctggccctggcgcaggcttctatcctcatagtggtattggtgggggtggcagcatgcatgttggtccaaacgatccacgcttctttccttctaatcccttccctgtgccctttggtggccctgggagtgttccaccaggtggtcgttatgatccaattggtccaccagatgttccaggatttgaaccttctcgctttgtgaggcgtccgaggcctccagctgggactactcacccagaccttgagttcttccagccggggccgcacgggcccttctga

SEQ ID NO: 98 - protein, 273 aa, Oryza sativa
MAVVKAARPAFRGAHDGVAFAANAAFLAAGYSLCAVGPAALTDPPPSGEEEVGIDGWNSMDNCYAFLYIKEERGKKKRVLVKCLVIGDVLAIDVLDLESQNKGPYNIQINVKDFFSEEQPKNYGNMYKNFAGLIETMNSNALSKLDEKDAGAAKNPEVETSSSIHSLVYPPIAPLGHDDAFPGPGAGFYPHSGIGGGGSMHVGPNDPRFFPSNPFPVPFGGPGSVPPGGRYDPIGPPDVPGFEPSRFVRRPRPPAGTTHPDLEFFQPGPHGPF

SEQ ID NO: 99 - DNA, 2268 bp, Oryza sativa
  CDS (1)..(2268)
atggcgagcgtcgacccgtcccggagcttcgtgagggacgtgaagcgcgtcatcatcaagattatcaggagtggggctttgcttgggcttttctgtggtttacttgatgtgacggcctatgtcgaagttgccaatctttcgactctggtgggcactgcagttgtctccagacaagatggaagattggctttgggcagggttggagctctgtgcgagcaggtgcctaaccaaagaaaagtggcaatgcaggttaaggaactgaactctttaggatacgaagtgattttggtcacctcaggtgctgttggagtggggcgacagcgacttaggtaccggaagcttgtcaatagcagctttgctgatctgcaaaagccacagatggagttagatggaaaggcttgtgccgctgttggtcagagtggactgatggctctttacgatatgttgtttaaccaactggatgtctcgtcatctcaacttcttgtcaccgacagtgattttgagaacccaaagttccgggagcaactcactgaaactgttgagtcattattagatcttaaagttataccaatatttaatgaaaatgatgccatcagcactagaaaggctccatatgaggattcatctggtatattctgggataatgacagtttagcaggactgttggcactggaactgaaagctgatctccttattctgctcagtgatgtggatgggttgtatagtggtccaccaagtgaaccatcatcaaaaatcatacacacttatattaaagaaaagcatcagcaagaaatcacttttggagacaaatctcgtgtaggtagaggaggcatgacagcaaaagtgaaggctgctgtcttggcttcaaatagcggcacacctgtggttattacaagtgggtttgaaaatcggagcattcttaaagttcttcatggggaaaaaattggtactctctttcacaagaatgcgaatttgtgggaatcatctaaggatgttagtactcgtgagatggctgttgccgcaagagattgttcaaggcatctacagaatttgtcatcagaggaacgaaaaaagatattgctagatgttgcagatgctttggaggcaaatgaggatttaataaggtctgagaatgaagctgatgtagctgcggcccaagttgctggatatgagaagcctttggttgctagattgactataaaaccaggaaagatagcaagccttgcaaaatctattcgtacccttgcaaatatggaagaccctataaaccagatacttaaaaagacagaggttgctgatgatttagttcttgagaaaacatcttgcccattaggtgttctcttaattgtttttgagtcccgacctgatgccttggttcagattgcatctttggcaattcgaagtggtaatggtcttctcctaaaaggtggaaaagaagctatcagatcaaacacgatattgcataaggttataactgatgctattcctcgtaatgttggtgaaaaacttattggccttgttacaactagagatgagatcgcagatttgctaaagcttgatgatgtcattgatcttgtcattccaagaggaagtaataagcttgtctctcaaatcaaggcgtcaactaagattcctgttcttgggcatgctgatggtatatgccacgtatatattgacaaatcagctgacatggatatggcaaaacatattgtaatggatgcaaaaattgattacccagcagcctgcaatgcaatggagaccttactagttcataaggatcttatgaagagtccaggccttgacgacatattagtagcactaaaaacagaaggagttaatatttatggtggacctattgcgcacaaagctctgggatttccaaaagctgtttcatttcatcatgagtatagttctatggcctgcactgttgagtttgttgatgatgttcaatcagcaattgaccatattcatcgttatggaagtgctcatacagattgtatcgtcactacagatgataaggtagcagagacttttctacgcagagttgatagtgctgctgtatttcataatgcaagtacgagattctctgatggggctcgttttggattgggtgctgaggttggcataagcacagggcgtatccatgcccgtggaccagtgggtgttgaaggtctcttaactacacgatggatcttgcgagggcgtgggcaagtggtgaatggtgacaaggatgtcgtgtacacccataagagtcttcctttgcaatga

SEQ ID NO: 100 - protein, 755 aa, Oryza sativa
MASVDPSRSFVRDVKRVIIKIIRSGALLGLFCGLLDVTAYVEVANLSTLVGTAVVSRQDGRLALGRVGALCEQVPNQRKVAMQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 101 - DNA, 2103 bp, Oryza sativa
  CDS (1)..(2103)
atggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagcagctggaataccttgaggaacgtcgcctcaaggatctggtgaagaagcattctgagttcatcagctaccctatctccttatggactgagaagacaaccgagaaggagatttctgatgatgaagacgaggaagagaagaaggatgctgaggagggaaaggttgaggatgttgatgaggagaaggaagagaaagagaagaaaaagaagaagatcaaggaagtctctcatgagtggaacgtgatgaacaagcagaaacctatttggttgaggaagccagaggagatcaccaaggaagagtatgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggccttctccaagaatctcaagcttggcatccatgaggactccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttccttgagaagctgaagaagaagggatatgaggtcctgtacatggttgatgccattgatgagtacgctgttggtcagcttaaggagtttgagggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtcgagcaagaagaccatggagatcaacccggagaattccatcatggacgagctccgcaagcgtgccgatgctgacaagaacgacaagtctgtgaaggacctggtgatgctgctcttcgagactgccctcctgacctccggcttcagccttgaggaccccaacaccttcggcaccaggatccaccggatgctcaagctcggcctgagcatcgacgaggacgagtctgctgaggctgacgccgacatgccgccgctggaggacgacgccggcgagagcaagatggaggaggtcgactaa

SEQ ID NO: 102 - protein, 700 aa, Oryza sativa
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENSIMDELRKRADADKNDKSVKDLVMLLFETALLTSGFSLEDPNTFGTRIHRMLKLGLSIDEDESAEADADMPPLEDDAGESKMEEVD

SEQ ID NO: 103 - DNA, 957 bp, Oryza sativa
  CDS (1)..(957)
atggccaccgcctttgactccccgaccgcctcgcccgccgcctctcccttcgacgacgactccttcctccgcttcgacgccgccgcgcccgctcccgcgccagcggacgccttcccgccatcaccggagccctacgccttccgccccgacgcgccctcccccttcggtatgcccgaggccaacggctccctccacgacgaccccttcgccgcccccgacaacgacaacggacccgtgctccctccgcccaaccagatgggcgctgacgagggcttcctgctgcgcgagtggcgccgcaagcttggcatggttgcaattttaaatgtttcttcgttctgtgtgactatagaacagatgctgacaccaattctgaacagtcaaaatgcaatccttctggaggaaaaggagaagaaggaaaaggagatgaggaatcaaatcatccttgatgccaaagaattcaagaaggcatttgttgagaagcgaaagctgaacgttgagacaagcaaggatcaaaaccgagaaagggagaagctttacctggccaatcaggagaagttccatgctggcgcagacaagcagtactggaaggcgatatcagaactgatcccacatgagattgcaaacattgagaagagaggagcaaagaaagacaaggataaggagaaaaagcctgggattgttgtgatccagggcccaaagcctgggaagcccactgacatgtcacggatgcgtcagatattgctgaagctgaagcacactccccctccacatatgaagccacctccccctcccgctgcagccaccggtaaggatggtgctgcaggaaaggatggagccaaggtagctgcggcagctagcaaggacgcctctgccaatggcagtgttccagagatggagaaggccgctgctgcagcagcacctgcagcagcagcaactgaacccattgctgctgcctga

SEQ ID NO: 104 - protein, 318 aa, Oryza sativa
MATAFDSPTASPAASPFDDDSFLRFDAAAPAPAPADAFPPSPEPYAFRPDAPSPFGMPEANGSLHDDPFAAPDNDNGPVLPPPNQMGADEGFLLREWRRKLGMVAILNVSSFCVTIEQMLTPILNSQNAILLEEKEKKEKEMRNQIILDAKEFKKAFVEKRKLNVETSKDQNREREKLYLANQEKFHAGADKQYWKAISELIPHEIANIEKRGAKKDKDKEKKPGIVVIQGPKPGKPTDMSRMRQILLKLKHTPPPHMKPPPPPAAATGKDGAAGKDGAKVAAAASKDASANGSVPEMEKAAAAAAPAAAATEPIAAA

SEQ ID NO: 105 - DNA, 735 bp, Oryza sativa
  CDS (1)..(735)
atggcggaggaggcggctagcaaggcagcgccgaccgatgcgctgtcgtccgtggcggcggaggcgccggtgacgagagaacggccggtccgagcggacttggaagtgcagattccgaagccctatttggcccgagctctggttgctccggacgtgtaccatcctgaaggaaccgaggggcgtgaccaccggcagatgagtgtgctgcagcagcatgtggctttcttcgacctggatggcgacggtatcgtttatccatgggaaacttatggaggactacgggaattgggcttcaacgtgattgtttcgttctttttggcgatagccataaacgttggtctaagctacccaactctgccaagctggataccatctctcctgttccctatacacataaaaaacatccacagggctaagcacggcagcgatagctcgacgtacgacaacgagggaaggtttatgccggtcaatttcgagagcatcttcagcaagaacgcccgcacggcgccggacaagctcacgttcggcgatatctggcggatgaccgaaggccaaagggtggcgctcgacttgcttgggaggatcgcgagtaagggggagtggatattgctctacgtgcttgcgaaagatgaggaaggattcctcaggaaggaggctgttcgccgctgcttcgatgggagcctattcgagtcgattgcccagcagagaagggaggcacatgagaagcagaagtag

SEQ ID NO: 106 - protein, 244 aa, Oryza sativa [sequence omitted]

SEQ ID NO: 107 - DNA, 1173 bp, Oryza sativa
  CDS (1)..(1173)
atggtttttttgcccagtgtaaaaccaactggaaacgaggttattggaattgatttgggaacaactaattcttgtgtttctgttatggagggaaagaaccccaaagtgatagagaattcagaaggcaccaggacaacaccatcagttgtggcctttaatcagaagggagagcgacttgttggaactccagccaagcgtcaagcagtgaccaacccacaaaacactttctttggcacaaaacgtctgattgggagacgctttgaggatccacaaacacagaaagagatgaaaatggtaccatacaaaattgtgaaggctccaaatggtgatgcttgggtggaaacaacagatggcaagcagtactcaccaaaggtcaaagcaacaaatggtgacacttttctgggaggagaagactttgataacactcttttggagttcttggtgagtgaattcaagaggagtgaagctattgatctggcaaaggacaggctggctctgcagaggttacgtgaagctgctgagaaggctaaaattgaactctcatcgactgcccagaccgagattaaccttccattcatcacagctgatgcttctggagctaaacatttgaacattacacttacaagatcaaagtttgaatctttggtgaatagcctcatcgagaggaccagagagccatgcaagaattgcttgaaggatgctggtataactaccaaggaggttgatgaggtccttcttgttggtggaatgacaagagttccaaaagtgcaggaaattgtttcagagatttttggcaagtccccaagcaaaggggtcaacccagatgaagctgtagccatgggtgcagccatacagggtggtattctccgtggagatgtaaaggagctgcttctccttgatgtgacccccctttcacttggtatcgagactcttggtggtatcttcaccagactgattaaccggaacactacaatccccacgaagaaaagtcagctcattgacatcagaaacaacgctgacactaccatttacagcgttgagaaaagtctgggagagtacagggacaagattcctgcagaggttgccactgagattgaaagattgggcagcatatgtctggtggtcggaggcgagcaggctccagaggctgagtacgaggaggtcaagaagtga

SEQ ID NO: 108 - protein, 390 aa, Oryza sativa
MVFLPSVKPTGNEVIGIDLGTTNSCVSVMEGKNPKVIENSEGTRTTPSVVAFNQKGERLVGTPAKRQAVTNPQNTFFGTKRLIGRRFEDPQTQKEMKMVPYKIVKAPNGDAWVETTDGKQYSPKVKATNGDTFLGGEDFDNTLLEFLVSEFKRSEAIDLAKDRLALQRLREAAEKAKIELSSTAQTEINLPFITADASGAKHLNITLTRSKFESLVNSLIERTREPCKNCLKDAGITTKEVDEVLLVGGMTRVPKVQEIVSEIFGKSPSKGVNPDEAVAMGAAIQGGILRGDVKELLLLDVTPLSLGIETLGGIFTRLINRNTTIPTKKSQLIDIRNNADTTIYSVEKSLGEYRDKIPAEVATEIERLGSICLVVGGEQAPEAEYEEVKK

SEQ ID NO: 109 - DNA, 624 bp, Oryza sativa
  CDS (1)..(624)
atgattttggaatggactgcagaagtgctggcaggaaaaagggcaaaagagcgactctttaactttgagagaattgcagcagcacagaagtttcactcaaaggaggcagaggaagaggcaaagaaggtgccagccaaaacttttactcctggacaggtggtggatgctcaagataccacaatggaggagcagggtccaaaagtagttgctccaacacctgagcaaatcacagctatcaaggctgccattgtgaattctcagacacttgaggaggttgcaaggcttgaaaaggcactgagcactggccaaattcctgctgaatttgcaatccccaagccagatgctaatatggctgatgcttcagaggaaactgaaaagatggagacagatggtcagaaccaagaaaatggggcggatgagaagaagcaaaatgaagaaagcaccccaattgaagaggcatatgcacacactgatataatctggcaccaagttggtgttagatttccgttttatttgtgggggcaaagccacattgcgatgcctgatctcgttgaatgctctcgctggaaacaagcttggggtattttataccttccagtaccgctagatttcttgatgttgtag

SEQ ID NO: 110 - protein, 207 aa, Oryza sativa
MILEWTAEVLAGKRAKERLFNFERIAAAQKFHSKEAEEEAKKVPAKTFTPGQVVDAQDTTMEEQGPKVVAPTPEQITAIKAAIVNSQTLEEVARLEKALSTGQIPAEFAIPKPDANMADASEETEKMETDGQNQENGADEKKQNEESTPIEEAYAHTDIIWHQVGVRFPFYLWGQSHIAMPDLVECSRWKQAWGILYLPVPLDFLML

SEQ ID NO: 111 - DNA, 756 bp, Oryza sativa
  CDS (1)..(756)
atgcttcctcctagggttgccccggccgccgccgccgccgcgcctacctatctcgccgccgcggcctcgacccctgcttccgtctggctgcctgtgccgcgtggtgccggacccggggcagtgtgcagggccgccgggaaagggaaggaggtgctcagcggcgtggtcttccagccattcgaggagctcaagggggagctctccctcgtcccccaggccaaggaccagtctctcgctaggcaaaagttcgtcgacgagtgcgaggccgccatcaacgagcagatcaatgtggagtacaatgcatcgtacgcgtaccactcccttttcgcctactttgatcgtgacaacgttgctctcaagggattcgccaaattcttcaaagaatccagcgatgaggagagggatcacgcagagaaactcatcaagtaccagaacatgcgtggaggcagggtgcggctccagtccatcgtcacacctttgacagagttcgaccatcctgagaaaggggatgccttgtatgctatggagttggccttggctctcgaaaagcttgtaaatgagaagttgcacaacctgcacagtgtggcatcaaggtgcaatgatccacagctgaccgacttcgttgagagcgaattccttgaggagcaggttgaagccatcaagaagatctctgagtatgtcgcccagctgagaagagtgggaaaggggcatggggtgtggcactttgatcagaagctgcttgaggaagaagcttga

SEQ ID NO: 112 - protein, 251 aa, Oryza sativa
MLPPRVAPAAAAAAPTYLAAAASTPASVWLPVPRGAGPGAVCRAAGKGKEVLSGVVFQPFEELKGELSLVPQAKDQSLARQKFVDECEAAINEQINVEYNASYAYHSLFAYFDRDNVALKGFAKFFKESSDEERDHAEKLIKYQNMRGGRVRLQSIVTPLTEFDHPEKGDALYAMELALALEKLVNEKLHNLHSVASRCNDPQLTDFVESEFLEEQVEAIKKISEYVAQLRRVGKGHGVWHFDQKLLEEEA

SEQ ID NO: 113 - DNA, 1905 bp, Oryza sativa
  CDS (1)..(1905)
atggcgcccaacctcagcaaggccaaggacgacctgatcggcgacgtggtcgccgtcgacgggctgatcaagccgccgcggttcacgctcaagggcaaggacctcgccgtggacggccacccgttcctcctcgacgtgccggccaacatccgcctcaccccggcgtccaccctcgtgcccaactccgacgtccccgccgccgccgccggcagcttcctcggcttcgacgcgccggcggccaaggaccgccacgtggtgcccatcggtaagctccgcgacacgaggttcatgagcatcttccgtttcaaggtgtggtggacgacccactgggtgggtacaaacggcagggacgtggagaacgagacccagatgatgatcctagaccagtcggggacgaagtcctcgccgaccggccctcggccctacgtcctcctcctcccgatcgtcgaggggcccttccgggcctgcctcgagtccgggaaggcggaggactacgtgcacatggtcctcgagagcgggtcgtccacagtcaggggctccgtgttccggagcgctgtgtacctgcacgcgggggacgacccgtttgacctggtcaaggacgccatgagggtggtccgtgcccacttcggcacgttccgcctcatggaggagaagacgccgccgccgatcgtcgacaagttcgggtggtgcacgtgggacgcgttctacctcaaggtgcacccggagggggtgtgggagggcgtgcggcggctcgccgacggcgggtgcccgccggggctggtgctgatcgacgacggctggcagtcgatctgccacgacgacgacgacctgggcagcggcgccgaggggatgaaccgcacgtcggccggcgagcagatgccgtgcaggctgatcaagttccaggagaactacaagttcagggagtacaagggcggcatgggcggcttcgtgagggagatgaaggcggcgttcccgacggtggagcaggtgtacgtgtggcacgcgctgtgcgggtactggggcggcctccgccccggcgcgccgggcttgccgccggcgaaggtcgtcgcgccgaggctctcgccgggcttgcagcgcaccatggaggacctcgccgtcgacaagatcgtcaacaacggcgtcgggctcgtcgacccgcgccgcgcgcgggagctctacgaggggctccactcccacctccaggcctccggcatcgacggtgtcaaggtcgacgtcatccatctgctggagatggtgtgcgaggagtacggcggtcgggtggagctcgcgaaggcctacttcgctgggctgacggagtcggtgcggcgccacttcaacggcaacggcgtgatcgcgagcatggagcactgcaacgacttcatgctgctgggcacggaggcggtggcgctgggccgcgtcggcgacgacttctggtgcaccgacccctccggcgaccccgacggcaccttctggctgcagggctgccacatggtgcactgcgcctacaactctctgtggatgggcgccttcatccacccggactgggacatgttccagtccacccacccctgcgccgccttccacgccgcctcccgcgccgtctccggcggcccgtctacgtcagcgacgccgtggggtgccacgacttcgacctgctccgccgcctcgcgctgccggatgggaccatactccgggcttcgaggcggcgaggaaggacggcgactggcggcggaggtggcggtgaagggcgccggggagatggtggcgtactcgtcggcgaggcctaggctgtgcaaggtgaacggccaggatgcggagttcaagtacgaggacggcatcgtcaccgtcgatgtgccgtggaccgggtcgtcgaagaagctgtcgcgtgtcgagtacttttactag

SEQ ID NO: 114 - protein, 634 aa, Oryza sativa
MAPNLSKAKDDLIGDVVAVDGLIKPPRFTLKGKDLAVDGHPFLLDVPANIRLTPASTLVPNSDVPAAAAGSFLGFDAPAAKDRHVVPIGKLRDTRFMSIFRFKVWWTTHWVGTNGRDVENETQMMILDQSGTKSSPTGPRPYVLLLPIVEGPFRACLESGKAEDYVHMVLESGSSTVRGSVFRSAVYLHAGDDPFDLVKDAMRVVRAHFGTFRLMEEKTPPPIVDKFGWCTWDAFYLKVHPEGVWEGVRRLADGGCPPGLVLIDDGWQSICHDDDDLGSGAEGMNRTSAGEQMPCRLIKFQENYKFREYKGGMGGFVREMKAAFPTVEQVYVWHALCGYWGGLRPGAPGLPPAKVVAPRLSPGLQRTMEDLAVDKIVNNGVGLVDPRRARELYEGLHSHLQASGIDGVKVDVIHLLEMVCEEYGGRVELAKAYFAGLTESVRRHFNGNGVIASMEHCNDFMLLGTEAVALGRVGDDFWCTDPSGDPDGTFWLQGCHMVHCAYNSLWMGAFIHPDWDMFQSTHPCAAFHAASRAVSGGPSTSATPWGATTSTCSAASRCRMGPYSGLRGGEEGRRLAAEVAVKGAGEMVAYSSARPRLCKVNGQDAEFKYEDGIVTVDVPWTGSSKKLSRVEYFY

SEQ ID NO: 115 - DNA, 735 bp, Oryza sativa
  CDS (1)..(735)
atggagtgtaaaacgtgcgcgacttcatgccgaaaggaagagtttttccatgggagctttgcgagagctttgaattctgacgcatatctgatatatctgatatatcttgcagttggcactggttttgttcagaatgacatgcttgcatcgttcggaagggatgattctatcaagggcattccatcactggcagcacgacacagtcagcatcgaagacttgaagttggctgtcgagcatcctctttagcgtcattcagctaccctgagttgacttcgaaacccagatggtggtggaggactgtagcatgtgtgccctacttgcttccactccacaacatgtggtcatatgccgatgtcatctaccagctacacacatacttgcaggggttttcgttggtgtacaccttcatcgatacaatgacactgtttccaggatggcttttgctggtgatttttatgacagtgtacttctttgtcgtgagacggaagtggtcgccgcactttctaaggttccatgtcatcttggctatcctcctggacactggctcccaagcagtggcaacaatgtgcacctggatgcccagcatcgtgtatcaggggacgcctatgcagtatttctggatggctattgctttcatacagatcttcacagtgctcgagtgcatgcgatgcgctcttgctgggatgtacccgaatgtccctttcaatatctcacacggcatttatccattctga

SEQ ID NO: 116 - protein, 244 aa, Oryza sativa
MECKTCATSCRKEEFFHGSFARALNSDAYLIYLIYLAVGTGFVQNDMLASFGRDDSIKGIPSLAARHSQHRRLEVGCRASSLASFSYPELTSKPRWWWRTVACVPYLLPLHNMWSYADVIYQLHTYLQGFSLVYTFIDTMTLFPGWLLLVIFMTVYFFVVRRKWSPHFLRFHVILAILLDTGSQAVATMCTWMPSIVYQGTPMQYFWMAIAFIQIFTVLECMRCALAGMYPNVPFNISHGIYPF

SEQ ID NO: 117 - DNA, 495 bp, Oryza sativa; identical to SEQ ID NO: 51
  CDS (1)..(495)

SEQ ID NO: 118 - protein, 164 aa, Oryza sativa; identical to SEQ ID NO: 52

SEQ ID NO: 119 - DNA, 315 bp, Oryza sativa
  CDS (1)..(315)
atggcagggtaccttgccgccgaagaggaagatcccggcgaggccggcggtggcgacgccgccccagatgacgacggtggaggagagcagcgaccagttgcggtagatcatcgtcgccggcggtcgtttgctccgggcgccgccgatcggtcgatgggagattggagacgacgaagaggggaaagaggaatcggaccaaaggcttctgagaagttattgaatgttacctggccaggcgtcctgaacttttgcttgtttggtttgccgccgctgcctgagaagggaaaaagtgatttgggtctgataattcactag

SEQ ID NO: 120 - protein, 104 aa, Oryza sativa
MAGYLAAEEEDPGEAGGGDAAPDDDGGGEQRPVAVDHRRRRSFAPGAADRSMGDWRRRRGERGIGPKASEKLLNVTWPGVLNFCLFGLPPLPEKGKSDLGLIIH

SEQ ID NO: 121 - DNA, 975 bp, Oryza sativa
  CDS (1)..(975)
atggcgacgcaagcgacggcgagagaaattgcggtggtgggagtgatcggcgcggggcagatgggctcgggcatcgcccagctcgccgccgccgccggctgcggcgtcctcctcctcgactccgacaccgccgccctctcccgcgccgtcgactccatctcctcctccctccgccgcctcgtcgccaagggccagctttctcaggcctcctgtgagcattccatcgagcagattaagtgcgtctccagtgtgcaagagcttagggatgcggatcttgtgattgaggctatcgtggagtcagaagacataaaaaagaagctgtttgttgagctggataagatcactaaaccttctgctattcttgcctccaatactagctcaatctctataacccgattggcttcagccactaatcgcccctgtcaggtgattggtatgcacttttttaaccctcctccgataatgaaattgattgaaatcatacgtggggctgatacatcagaagaggttttcactaaagtcaaatctttttctgaaaggcttgggaagacggtaatatgctcacaagactaccctggtttcatcgtgaaccgcatcctcatgccaatgatcaacgaggcgttctgggcactttacactggagtagcgactaaagaggacattgatacggggatgaagctaggcacgaatcatcccatgggacctctgcagcttgctgatttcattggtttagatgtctgcctttcagtgcttcgggtacttcataatggcctaggagatagcaaatacagcccttgccctcttctcgttcaatatgttgatgctggccgacttgggaagaagcgtggacaaggcgtatactcgtataggacaaggtcttcatccattaaaccgaggtccaacataaacacctacaagttacgcctttgcaagttgcaacaacaggatactgcaggccatgtttgggctatgtaa

SEQ ID NO: 122 - protein, 324 aa, Oryza sativa
MATQATAREIAVVGVIGAGQMGSGIAQLAAAAGCGVLLLDSDTAALSRAVDSISSSLRRLVAKGQLSQASCEHSIEQIKCVSSVQELRDADLVIEAIVESEDIKKKLFVELDKITKPSAILASNTSSISITRLASATNRPCQVIGMHFFNPPPIMKLIEIIRGADTSEEVFTKVKSFSERLGKTVICSQDYPGFIVNRILMPMINEAFWALYTGVATKEDIDTGMKLGTNHPMGPLQLADFIGLDVCLSVLRVLHNGLGDSKYSPCPLLVQYVDAGRLGKKRGQGVYSYRTRSSSIKPRSNINTYKLRLCKLQQQDTAGHVWAM

SEQ ID NO: 123 - DNA, 756 bp, Oryza sativa; identical to SEQ ID NO: 111
  CDS (1)..(756)

SEQ ID NO: 124 - protein, 251 aa, Oryza sativa; identical to SEQ ID NO: 112

SEQ ID NO: 125 - DNA, 1185 bp, Oryza sativa
  CDS (1)..(1185)
atggcgatgtggagggcggcggcggggcatcttctcggccgcgcgctcggctccagggccgcgcacacatcagcaggcagcaagaagatcgtgggtgtgttctacaagggcggcgagtacgccgacaagaatcccaacttcgtcggctgcgtggagggcgctctcggcatccgcgaatggcttgagtccaaggggcatcactacattgtcaccgacgacaaggaggggctaaacagcggagaattaaggatgatattcatctggttgatggaaggtggaaaggaggttcttgatctggagaagcacattgaggatatgcatgtcttgatcaccacccctttccacccagcctatgttagcgcagaaaggatcaagaaggcaaagaacctcgagctgcttctcacagctgggattgggtcagatcatattgatctgccagcagctgctgcagcaggtttaactgtggcagaggttaccggaagtaacactgtgtcggtggcagaagatgagctcatgcgcattttgattttgctcaggaacttcttgcccgggtatcagcaggttgttcatggtgaatggaatgttgctggcattgcctatagggcttatgatcttgaaggaaaaactgtggggactgttggggctggtcgtattggcaggctcttacttcagcgtcttaagccctttaactgcaacctgctgtaccatgacagacttaaaattgacccagaacttgagaaagaaattggggccaaatatgaagaggatctcgatgctatgcttccaaagtgtgatgtcattgtgatcaatacacctcttacagagaaaacaagaggtatgtttaataaagaaagaattgcaaagatgaagaaaggtgtaatcattgtgaataatgctcgaggagcaatcatggatacccaggcggttgcagacgcttgctctagtggtcaagttgcaggatatggtggtgatgtctggttcccccaaccagcaccaaaggatcacccatggcgatacatgcctaatcatgccatgacccctcatatctctgggactacaattgatgcacagctgagatacgcagcaggagtgaaggacatgctggacaggtacttcaaaggggaagacttcccggtgcagaactacatcgtcaaggaaggtcagctcgcgagccagtaccagtaa

SEQ ID NO: 126 - protein, 394 aa, Oryza sativa
MAMWRAAAGHLLGRALGSRAAHTSAGSKKIVGVFYKGGEYADKNPNFVGCVEGALGIREWLESKGHHYIVTDDKEGLNSGELRMIFIWLMEGGKEVLDLEKHIEDMHVLITTPFHPAYVSAERIKKAKNLELLLTAGIGSDHIDLPAAAAAGLTVAEVTGSNTVSVAEDELMRILILLRNFLPGYQQVVHGEWNVAGIAYRAYDLEGKTVGTVGAGRIGRLLLQRLKPFNCNLLYHDRLKIDPELEKEIGAKYEEDLDAMLPKCDVIVINTPLTEKTRGMFNKERIAKMKKGVIIVNNARGAIMDTQAVADACSSGQVAGYGGDVWFPQPAPKDHPWRYMPNHAMTPHISGTTIDAQLRYAAGVKDMLDRYFKGEDFPVQNYIVKEGQLASQYQ

SEQ ID NO: 127 - DNA, 567 bp, Oryza sativa
  CDS (1)..(567)
atgagcgggagcagcaacagcagcctggagacgcgcacgttcctggacgaggtgcgcggcctggagaagaactggatggtcgacctcggccacccgctcctcaaccgcgtcgccgagagcttcgtcaaggccgccggcatcggcgcagtccaggcggtcgcgcgggagtcttacttcatggccatggaaggcacttgcttagttgctgctgctacaggggagggtgggggcacgggagccgtgtccgactccaccggcgccaggaagcgatcgttcccggatctcaacggagggaacagcagcaagtcagctgaggctatggtgaaaagcgtgagcaaagagtctctccagtgggggctcgcggccgggttgcactcggggctgacctacggcctgacggaggcgcgcgggacgcacgactggaagaacagcgtggtggcgggcgccctcaccggcgcggccgtcgcgctcacctcggaccgcgcgtcgcacgagcgggtggtgcagtgcgccatcgccggcgccgcgctgtccacggccgccaacgtgctctccggcatattgtga

SEQ ID NO: 128 - protein, 188 aa, Oryza sativa
MSGSSNSSLETRTFLDEVRGLEKNWMVDLGHPLLNRVAESFVKAAGIGAVQAVARESYFMAMEGTCLVAAATGEGGGTGAVSDSTGARKRSFPDLNGGNSSKSAEAMVKSVSKESLQWGLAAGLHSGLTYGLTEARGTHDWKNSVVAGALTGAAVALTSDRASHERVVQCAIAGAALSTAANVLSGIL

SEQ ID NO: 129 - DNA, 1548 bp, Oryza sativa
  CDS (1)..(1548)
atggctccgaccgcatctcttctcctctccccgaggccgctgccggcgagccgccgggtcccctcgctcccggcgctctcggcttccggtcgcctgcgcctccgccgcgcccgcgccgacacacggctccgcgtggcggcgccgccgtccgtccccggggaggcggaccaggcgcccggggagaccgagccgagcacgtcgtcggccgacgagaagttcgtgtggagggaccactggtaccccgtgtccctcgtcgaggacctcgaccccagcgtgcccaccccgttccagctcctcaaccgcgacctcgtcatctggaaggacccaaaatccggcgagtgggtcgccctcgacgaccgttgcccccatcgcctcgcgcccctctcggaggggcggatcgatgagacggggtgcttgcagtgctcataccacggctggtcattcgatggctccggcgcgtgcacccggatcccgcaggcggcgcccgaggggccggaggccaaggctgtgaggtcgccgaaggcgtgcgcgatcaagttccccaccctcgtctcgcaagggctgctcttcgtgtggcccgacgagaatgggttaccgaaggagtttgaggatcctgcgttctccacggtgaccatccagagggatctgtactatggctatgatacattgatggagaacgtctctgatccgtcgcatatagaatttgctcaccacaaggtcactggtcgaagagatcgagccaggcctttgccattcaagatggaatcaagtggtgcatggggatattcagggtcaaattctggaaaccctcgcatcagtgcaacttttgtggccccttgctatgcactgaacaaaattgagatagacacaaagttacccatttttggagatcagaaatgggtcatatggatttgctctttcaacattccaatggccccagggaagactcgttctatagtttgtagtgctcggaactttttccagtttagcatgccaggaaaagcatggtggcagcttgtccctcgatggtatgagcattggacttcaaatttggtctatgatggtgatatgatagttctgcaagggcaagagaagattttcttgtctgcatcgaaggagtcttctgcagatattaatcagcagtacacaaagatcacgtttacacccacgcaggctgaccgttttgttttggcattccgggcatggctaaggaaatttggtaacagccaacctgactggtttggaaatcctagccaagaagtgttgccttccactgtcctttcaaagcgtgagatgctagatagatatgagcagcacacactgaaatgctcatcttgcaaaggggcatacaacgccttccagactctgcaaaaggtcttcatgggagcgacagtggcgttctgtgcaactgctgggattcctgcggatgttcagttcagattattgcttgccgctgctgctttggttagtgccgctgtagcgtacgcattttatacgctccagaagaattttgtatttgtagattacgtgcatgctgagattgattaa

SEQ ID NO: 130 - protein, 515 aa, Oryza sativa
MAPTASLLLSPRPLPASRRVPSLPALSASGRLRLRRARADTRLRVAAPPSVPGEADQAPGETEPSTSSADEKFVWRDHWYPVSLVEDLDPSVPTPFQLLNRDLVIWKDPKSGEWVALDDRCPHRLAPLSEGRIDETGCLQCSYHGWSFDGSGACTRIPQAAPEGPEAKAVRSPKACAIKFPTLVSQGLLFVWPDENGLPKEFEDPAFSTVTIQRDLYYGYDTLMENVSDPSHIEFAHHKVTGRRDRARPLPFKMESSGAWGYSGSNSGNPRISATFVAPCYALNKIEIDTKLPIFGDQKWVIWICSFNIPMAPGKTRSIVCSARNFFQFSMPGKAWWQLVPRWYEHWTSNLVYDGDMIVLQGQEKIFLSASKESSADINQQYTKITFTPTQADRFVLAFRAWLRKFGNSQPDWFGNPSQEVLPSTVLSKREMLDRYEQHTLKCSSCKGAYNAFQTLQKVFMGATVAFCATAGIPADVQFRLLLAAAALVSAAVAYAFYTLQKNFVFVDYVHAEID

SEQ ID NO: 131 - DNA, 1566 bp, Oryza sativa
  CDS (1)..(1566)
atgcccagtgcccatcctctgcctgcctccagccaagcgaccacagcatgggccacacggactctgacaagcaccagatctgtgggccgtactccaaccctatccactccacacgcccccggcccatacacctcgtccaccaacgccgaggccatcgccacccagccctatcccctcactgacaagtgggccaccaacctgcatcctggcccaatcacgtcccaccgaatcgccacgtcagctctgcatcagcagcggatgaagcaggcggcggcggcggcgcagcagcagcagatgatgcagcaggcgctgctcatgcagcagcagcaggctgcggcggtggcggcggcggcgcagcagcagcaggcgcccttgttccccccgcaccacccgcacccgggcctcctcgcggcgccgcagatagagcccattgttagtggcaacctgcctcctggatttgattcaagtacatgccggagtgtgtatgttggcaatatccatcttcaagtgacggattcactgctacatgaggtcttccaaagtattggtccagtagaaggatgcaagctcatcaggaaggaaaagtcatcctttggttttgttgactattatgaccgtagatctgctgcaattgcaattgtatcactcaacggtagacaattgtttggccagccaataaaagtcaattgggcatatgcaagtactcaaagagaggatacatcaggccattttaatatttttgttggcgatctttgcccggaagtaacagatgctgctttgtttgcttttttcgctggatttaccagttgctcagatgctagggtaatgtgggatcagaaaactggacgatccagaggttttggttttgtttctttcagaaatcagcaggacgcacaaaatgccataaatgaactgaatgggaagtggctcggcaaccgtcaagttcgttgcaattgggcaacaaagggtgctaatgctggtgaagagaaacaaaatacagactccaagggtatgatagagttgacaaatggttcatcagaaggtggaaaggataatgcaaatgaagatggtcctgaaaacaacccacagtacacgactgtttatgttggcaatcttcctcatgatgtcaacagcaatgatgtgcacagatttttccattcacttggggttggttcaattgaggaggtgcgtgtaacgcgtgataaaggttttggctttgtgcgttacagcacccatgaagaagctgctctagcaattcagactggtaatggacaacttattggcggtaggcagatcaagtgttcctggggaagcaagccaactccaccagggacagcatccgcgcccctaccccctccagcaccagcaccattcaatcctggcatgtcggcgaccgacctcctagcctacgagcgcaccctggcgctgagcaagatggcagcgaacccggccctgatgagtcagcacgccgccctaaagcaggctgccgccatggggatgggcgccggagccagccaggccatctacgacggcggctaccagagtgccaacgccgtcttctactag

SEQ ID NO: 132 - protein, 521 aa, Oryza sativa
MPSAHPLPASSQATTAWATRTLTSTRSVGRTPTLSTPHAPGPYTSSTNAEAIATQPYPLTDKWATNLHPGPITSHRIATSALHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 133 - DNA, 687 bp, Oryza sativa
  CDS (1)..(687)
atgtcggactccgaggagcaccacttcgagtcgaaggccgacgccggcgcctccaagacctacccgcagcaggctgggaccatccgcaaaaatggctacatagtcatcaagaaccgcccctgcaagctacactgtctgcaacttggtactagtagcacacggtttaccactgcggtgactcgcgtacttgttgcgtgggtagcaaacttgtctgaaactcggtacttgcactgtgccagtctagcaatgctgggatggctctatgatgacctagctaaagtcatattctccatctggcctcgtgttgatggctcattccttcactggattgttgttgaggtttcaacctctaaaactgggaagcacggtcacgccaagtgccactttgttgcaattgacatctttactgccaagaagctcgaagatattgtgccatcttctcacaactgtgatgtcccgcatgtgaaccgtacggagtaccagctcattgatatatctgaggatggatttgtgagtctgttaactgaaaatggcaacaccaaggatgacctcaggctccctactgatgataacctgcttagtcagatcaaggatggatttggagaagggaaggacctggtggtgactgttatgtctgccatgggagaggagcagatctgcgcgctgaaggacatcggcccgaagtaa

SEQ ID NO: 134 - protein, 228 aa, Oryza sativa
MSDSEEHHFESKADAGASKTYPQQAGTIRKNGYIVIKNRPCKLHCLQLGTSSTRFTTAVTRVLVAWVANLSETRYLHCASLAMLGWLYDDLAKVIFSIWPRVDGSFLHWIVVEVSTSKTGKHGHAKCHFVAIDIFTAKKLEDIVPSSHNCDVPHVNRTEYQLIDISEDGFVSLLTENGNTKDDLRLPTDDNLLSQIKDGFGEGKDLVVTVMSAMGEEQICALKDIGPK

SEQ ID NO: 135 - DNA, 555 bp, Oryza sativa
  CDS (1)..(555)
atggcgggcgaggcggcggcggcggagcggtgggtgggggcggcggtggacttctcggaggggagccgcgcggcgctgcggtgggcggcggacaacctgctccgcgccggcgaccacctcatcctcctccacgtcctcaaggaccccgactacgagcagggcgagaccctcctctgggaggccaccggctcccgtacgctcctcctctcccttctcttccacttctacctcccatggcgctcgccattgattcccctctcggatttctctgaacctacaattgcaaagaaatatggagcaaagcctgatgccgaaacattggacatgcttaatactgtggccaggcagaaggaggttgtggtggttttcaaagtcctttggggagatccccgtgagaagctatgccaagccatcaacgaaatccccatgagctgcttggttattggaagcaggggtcttggcaaactcaagagggtgctgttaggtagcgtcagcgactacgtcgtgaacaacgccacttgcccagtcacagttgtcaagacagccgatggttga

SEQ ID NO: 136 - protein, 184 aa, Oryza sativa
MAGEAAAAERWVGAAVDFSEGSRAALRWAADNLLRAGDHLILLHVLKDPDYEQGETLLWEATGSRTLLLSLLFHFYLPWRSPLIPLSDFSEPTIAKKYGAKPDAETLDMLNTVARQKEVVVVFKVLWGDPREKLCQAINEIPMSCLVIGSRGLGKLKRVLLGSVSDYVVNNATCPVTVVKTADG

SEQ ID NO: 137 - DNA, 879 bp, Oryza sativa
  CDS (1)..(879)
atggccggctacccgccaaatcccggctccggctacccctacggcggcgccggcggctacggcgccccgccaccgccgtacggctcctcccccgccccctccgccccgccgtacggcgcgaagcctcccaaggaaggtaagacctcctcctcttccgccccttactacggcggcggaggcggctacggtgccccgccatccacccagccctacggcagcggaggcggctacggcgccccgccctccagccagccgtacggcgcgccgtacggggccccgccgccctcgtcggcgccctacggggcgcccggcgggtacggcagcccgttcgcgtcgctggtgccgtcggcgttcccgcccgggacggatcccaacgtggtggcgtgcttccaggcggcggaccgcgacggcagcgggatgatcgacgacaaggagctgcagtccgcgctgtccgggtacagccagagcttcagcctccgcaccgtccacctcctcatgtacctcttcaccaacaccaacgtccgcaagattggtcccaaggaatttacctctgtgttttacagtcttcagaattggaggtccattttcgagaggtttgatcgtgaccgaagtggtaaaattgatgcaacagaattgcgtgatgctcttctcagtctgggatattcagtttctccaactgtgctagacttgcttgtgtcaaagtttgacaagactgggggcaagaacaaagccattgaatatgataacttcattgaatgctgcctcacagttaagggtctgactgagaagttcaaggaaaaagacacagccttctcgggctctgcgacttttacttacgaggctttcatgctgactgtactcccttttctcattgcataa

SEQ ID NO: 138 - protein, 292 aa, Oryza sativa
MAGYPPNPGSGYPYGGAGGYGAPPPPYGSSPAPSAPPYGAKPPKEGKTSSSSAPYYGGGGGYGAPPSTQPYGSGGGYGAPPSSQPYGAPYGAPPPSSAPYGAPGGYGSPFASLVPSAFPPGTDPNVVACFQAADRDGSGMIDDKELQSALSGYSQSFSLRTVHLLMYLFTNTNVRKIGPKEFTSVFYSLQNWRSIFERFDRDRSGKIDATELRDALLSLGYSVSPTVLDLLVSKFDKTGGKNKAIEYDNFIECCLTVKGLTEKFKEKDTAFSGSATFTYEAFMLTVLPFLIA

SEQ ID NO: 139 - DNA, 825 bp, Oryza sativa
  CDS (1)..(825)
atggggagcttcgcgaggaaggagcaccagttcctcgccgagcttggcctcgcgccgcggaaccccgggtccttcgcctgcggcgcctggggcggctcgggccccgtcgtcacgtccaccaacccgacgaacaaccaggcgcgtctccccccacacgatccgctcggttctaggcgctcgatttggtttgggccgccctggcatttttggggtgtcatcgcggaggtcgtggaggcgtccgcgcgtgagtacgaggagggcatgcgcgcctgctacgatgccgccaagacctggatggcgattccagctccaaagcgaggagaaattgttaggcaaattggtgatgcattgagagcaaagctccatcacctgggcaggcttgtgtcacttgagatggggaaaattcttcctgaagggattggagaggttcaggggggaaaaattctttatggaggatctgcaattgaatctgagggaaactttgttcagccaacaattgtggaaatttcaccctctgcaccggttgtgagagaagaactctttggtcctgttctttatgtgatgaaagttcagaatctgaaggaagcagttgaaatcaacaattctgttcctcaaggattgagcagttctatatttacaaagagaccagatattattttcaagtggattgggcctcatggtagtgactgtggcattgttaatgtaaatattcccacaaatggtgctgaaattggtggagcttttggtggagaaaaagctactggtggtggacgagaagcagggagtgattcgtggaagcagtacatgaggagggccacttggtaa

SEQ ID NO: 140 - protein, 274 aa, Oryza sativa
MGSFARKEHQFLAELGLAPRNPGSFACGAWGGSGPVVTSTNPTNNQARLPPHDPLGSRRSIWFGPPWHFWGVIAEVVEASAREYEEGMRACYDAAKTWMAIPAPKRGEIVRQIGDALRAKLHHLGRLVSLEMGKILPEGIGEVQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATW

SEQ ID NO: 141 - DNA, 453 bp, Oryza sativa
  CDS (1)..(453)
atggcgaacgcgacgtcgggtgtggcggtgagcgaggagtgcaaggcgaggttccaggagctgagggcggggcgggcccacaggttcgtggtgttcaagatcgacgacgcgatgcggcaggtggtggtcgacagggtgggcccacgcgacgccggcttcgacgagctcaccgccagcctccccgccgacggctgccgctacgccgtgtacgaccacgacttcaccgtcagcgacgccacggccacggcggccgccggcgagggcggcgaggcgccgcgcagcaagatcttcttcgtgtcgtggtcgccggcggcggcggacgtgaggagcaagatggtgtacgcgagctccaacgaagggttcaagaaggagctcgacggcgtccagatcgacctgcaggccaccgaccccagcgagctcaccctcgacgtgctcaaggaccacacctcctaa

SEQ ID NO: 142 - protein, 150 aa, Oryza sativa
MANATSGVAVSEECKARFQELRAGRAHRFVVFKIDDAMRQVVVDRVGPRDAGFDELTASLPADGCRYAVYDHDFTVSDATATAAAGEGGEAPRSKIFFVSWSPAAADVRSKMVYASSNEGFKKELDGVQIDLQATDPSELTLDVLKDHTS

SEQ ID NO: 143 - DNA, 834 bp, Oryza sativa
  CDS (1)..(834)
atggaggaagcacgggagaatgggggcgtcggcggctctgtgctgcctctggcctcgctcatctctccaactgggaacgaggtgcagatttctgagctagagggcaagatcatagggctgtacttcgctgcaaactggtaccccaagtgcgaggccttcacccccgcgctgaccgccgcctaccaccagctcaaggagcacggcgccggcttcgaggtcatcttcgtgtcgtgcgacgagaatcgaccgtccttcgagaggttccaccgcgccatgccgtggcccgccgtgcccttcggcgacatcgggtgcaagaagcgcctcagcgagaggttccaggtcgagggcatcccgcgcctggtggtgctcgccccgaacggcgaggtcgtgcagcctgatgccgtcgagctcgtgcaccgctacggcgatcgggcattccccttcacgtcggcgagggtggcggagctggaggccgacgagcagcgcaagttcgcgtctcagacgctggagaagatcttctccgtcagcgggaaagactacgtgaacggtagccaagaacagaattgcctccgttgttgttgttgtcgttcacggcacctcctcctggcgcaccagctccggatccggatccagctcctgtcggcggcgtaccacctccgctggcagtggcggcggcaactccagacatggcgacgagcagtcgtgtgggaggcactccccaaaaacctgatcacccgcctacccggtgcagatctcaggcgaaggagaaagaacgtggacgcgctgttgcggagggaatcgtgggaacgtgggttagtggctgcaaaaggatag

SEQ ID NO: 144 - protein, 277 aa, Oryza sativa
MEEARENGGVGGSVLPLASLISPTGNEVQISELEGKIIGLYFAANWYPKCEAFTPALTAAYHQLKEHGAGFEVIFVSCDENRPSFERFHRAMPWPAVPFGDIGCKKRLSERFQVEGIPRLVVLAPNGEVVQPDAVELVHRYGDRAFPFTSARVAELEADEQRKFASQTLEKIFSVSGKDYVNGSQEQNCLRCCCCRSRHLLLAHQLRIRIQLLSAAYHLRWQWRRQLQTWRRAVVWEALPKNLITRLPGADLRRRRKNVDALLRRESWERGLVAAKG

SEQ ID NO: 145 - DNA, 486 bp, Oryza sativa
  CDS (1)..(486)
atgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctag

SEQ ID NO: 146 - protein, 161 aa, Oryza sativa
MSLIRRSNVFDPFSLDLWDPFDGFPFGSGGSSSGSIFPSFPRGASSETAAFAGARIDWKETPEAHVFKADVPGLKKEEVKVEVDDGNILQISGERNKEQEEKTDQWHRVERSSGKFLRRFRLPDNAKPEQIKASMENGVLTVTVPKEEAKKPDVKSIQISG

SEQ ID NO: 147 - DNA, 642 bp, Oryza sativa
  CDS (1)..(642)
atgggcgtggaggtgtgcgtcaaggccgccgtcggccacccggacacgctcggcgactgtccattctcgcagagggtgctgctgactctggaggagaagaaggtgccctacgagatgaagctcatcgacgtccagaacaaccccgactggtttctgaagatcagcccagaggggaaggtgcctgtgtttaacggtggtgatggcaaatggattcctgattctgatgtgatcactcaagtcattgaggagaagtacccaaccccgtctcttgtcacccctcctgagtatgcatcagtgggatcaaaaattttctcatgcttcacaacgttcttgaagagcaaggatccaaatgatggttcagagaaggcacttcttactgaactgcaggcactcgaggagcatctgaaagctcatggcccctttatcaacgggcagaacatttcagctgctgaccttagcctggcaccaaagctctaccatctccaggttgctctggagcatttcaaaggctggaagatcccggaagacctaaccaatgttcatgcttacacagaggctctgtttagccgcgaatctttcatcaagacgaaggcagctaaggagcacctgattgctggatgggcaccaaaagtgaatgcgtaa

SEQ ID NO: 148 - protein, 213 aa, Oryza sativa
MGVEVCVKAAVGHPDTLGDCPFSQRVLLTLEEKKVPYEMKLIDVQNNPDWFLKISPEGKVPVFNGGDGKWIPDSDVITQVIEEKYPTPSLVTPPEYASVGSKIFSCFTTFLKSKDPNDGSEKALLTELQALEEHLKAHGPFINGQNISAADLSLAPKLYHLQVALEHFKGWKIPEDLTNVHAYTEALFSRESFIKTKAAKEHLIAGWAPKVNA

SEQ ID NO: 149 - DNA, 654 bp, Oryza sativa
  CDS (1)..(654)
atgccgacgccggcgctgcccctcgtcggcggtgacaggccgatgtcgccgctcccggcgccggatgtcgccgccgcgccgcggacggcggaggaggtctggaaggagataactggtgcgggcgtcgccgccgccgccggcggcgtggtgccccctgctgctgctgctgctgctgccccggccgtcgtcgctggcgctggcgctggcaccggcgcggagatgacgctggaggactttctggcgagggagggcgcggtgaaggaagacgaggctgtggtcaccgatccctcggcggccaaggggcaggtggtgatggggttcctgaacggggcagaggtcaccggaggcgtcaccggcggcaggagcaggaagaggcacctgatggatccgatggaccgcgccgcgatgcagcggcagaagcgaatgatcaaaaatcgcgagtcggcggcgaggtcacgggagaggaagcaggcctatattgctgagctcgagtcgctggtcacgcaactcgaggaggagaacgccaagatgttcaaagaacaggaggagcaacatcagaaacgacttaaagagctcaaggaaatggttgttccagtcatcattaggaaaacgtcagcacgagatcttagaagaacaaactcgatggagtggtag

SEQ ID NO: 150 - protein, 217 aa, Oryza sativa
MPTPALPLVGGDRPMSPLPAPDVAAAPRTAEEVWKEITGAGVAAAAGGVVPPAAAAAAAPAVVAGAGAGTGAEMTLEDFLAREGAVKEDEAVVTDPSAAKGQVVMGFLNGAEVTGGVTGGRSRKRHLMDPMDRAAMQRQKRMIKNRESAARSRERKQAYIAELESLVTQLEEENAKMFKEQEEQHQKRLKELKEMVVPVIIRKTSARDLRRTNSMEW

SEQ ID NO: 151 - DNA, 1413 bp, Oryza sativa
  CDS (1)..(1413)
atggccatggcaacggcaacccccgcggcgcagaatgagcagcaggagaagggggggttggagtacgtatatctgtcggggctgggcaacagcttgtcgtcggaggcggtggcggggacgctcccgcgcgggcagaacagcccgctggtctgcccgctgggactctacgccgagcagctctccggcacgcccttcaccgccccgcgcgcccgcaacctccgaacatggctgtaccggatcaagccttcggtgacccacgagcccttccacccccgtcgccccgcccacccccgcctcattggggatttcgaccgcaccaccaccgacaccgtcgccacgcccacccagctgcgctggcgccccgccgacgtgcccccccaccatcctcccctcgatttcatcgatggcctctacaccgtctgcggcgctggcagctccttcctgcgccacggatacgccatccacatgtacgctgctaacaagtccatggacggatgcgccttttgcaacgctgacggcgatttcctcattgtcccccagcaaggaaagctgttgatcacaactgaatgtgggaagctgctagtcccacctggtgaaattgttgtcattccccagggttttcgctttgctgttgatttgcccgatggtccttcacgtggctatgtttctgagattttcggtacccactttcagctccctgatcttggcccgattggtgcaaatggcttggcttcggcaagggatttcctttccccaacagcatggtttgagcaagtccaccgcccaggatacacaattgtgcagaaatatggtggtgagctattcactgccactcaggacttttctccatttaatgtggtagcgtggcatggaaattatgtcccttacaagtacgacctgagtaaattctgtccatttaacactgttctattcgatcatgctgatccatcagtaaatacagtgctgactgcaccaactgataagcctggtgtcgcattgcttgattttgtgatattcccgcctagatggttggtcgctgagaacacatttcgccctccatactatcatcgcaattgcatgagtgaatttatgggattgatctatggaatatacgaggccaaagctgatggttttcttcctggaggtgctagccttcacagttgcatgacacctcatggcccagacaccaagacatacgaggcaacaatcagccgtcctgatgccaatgagccatcaaggctaagcggcacgcttgcattcatgttcgagtctgcactcatccccagggtttgccaatgggccctcgattccccatcccgggatctcgattactaccagtgctggattggattgaaatcccacttctcacatgacaatggaggggcaaccagcgaagaaccatgcagaaagtag

SEQ ID NO: 152 - protein, 470 aa, Oryza sativa
MAMATATPAAQNEQQEKGGLEYVYLSGLGNSLSSEAVAGTLPRGQNSPLVCPLGLYAEQLSGTPFTAPRARNLRTWLYRIKPSVTHEPFHPRRPAHPRLIGDFDRTTTDTVATPTQLRWRPADVPPHHPPLDFIDGLYTVCGAGSSFLRHGYAIHMYAANKSMDGCAFCNADGDFLIVPQQGKLLITTECGKLLVPPGEIVVIPQGFRFAVDLPDGPSRGYVSEIFGTHFQLPDLGPIGANGLASARDFLSPTAWFEQVHRPGYTIVQKYGGELFTATQDFSPFNVVAWHGNYVPYKYDLSKFCPFNTVLFDHADPSVNTVLTAPTDKPGVALLDFVIFPPRWLVAENTFRPPYYHRNCMSEFMGLIYGIYEAKADGFLPGGASLHSCMTPHGPDTKTYEATISRPDANEPSRLSGTLAFMFESALIPRVCQWALDSPSRDLDYYQCWIGLKSHFSHDNGGATSEEPCRK

SEQ ID NO: 153 - DNA, 831 bp, Oryza sativa
  CDS (1)..(831)
atgagccaggagcagccgaggaggccgtcggagaaggcggccggcggcggcggcggcgagcaggggatccggtatggcgacgtgttcccggtgaccggaagcctcgcggccaagcccatcgccccgcgggacgcggcgacgatgcagtcggcggagaacctcgtgctggggaagacggtcaagggcggccccgccgccgccatggagtccgcggcgagtcgtaacgaggagatgggcgtcgtcgggcatgaccaggccacggacgccgccgccgagcagggcgtcaacgtctccgacaccctcgtccccggcggcggccgcatcgtcaccgagttcgtcgccggccaggcggtgggtcactacgtggagcaggacgatggcgccgccgtggttgcaggagtcgtcggcgccgcccccggcgcggtacgggtggaggaacctgcgaagataacaatcggcgaggcgctggaggcggcggcgctggcggcaggagggacgccggtggaacgcagcgacgcggcggccattcaggcggccgaagcaaaagccaccggcacggacacctacatgcccggcggcttggcggcgcaggcgcagtccgccgccgtggccaacctctggacggcgcgcgacgccgacaagaccaagctcggcgacgtcctctcgaacgcgacggcgaagctcgcggcggacaaggaggtggagagcggcgacgcggcgagggtggccggagcggagatgcgcaacaagcccggcgcggcggcgaggccgggcggcgtggccgcgtccatggccgcggccgcgcgcctcaaccgcggcccaacgacatga

SEQ ID NO: 154 - protein, 276 aa, Oryza sativa
MSQEQPRRPSEKAAGGGGGEQGIRYGDVFPVTGSLAAKPIAPRDAATMQSAENLVLGKTVKGGPAAAMESAASRNEEMGVVGHDQATDAAAEQGVNVSDTLVPGGGRIVTEFVAGQAVGHYVEQDDGAAVVAGVVGAAPGAVRVEEPAKITIGEALEAAALAAGGTPVERSDAAAIQAAEAKATGTDTYMPGGLAAQAQSAAVANLWTARDADKTKLGDVLSNATAKLAADKEVESGDAARVAGAEMRNKPGAAARPGGVAASMAAAARLNRGPTT

SEQ ID NO: 155 - DNA, 3483 bp, Oryza sativa
  CDS (1)..(3483)
atggagagaagcagcggcgggggcatggaaaaggaggagtcgacggccggggcaggaaggaggagaaggggagggggtgcgggcggcgtctccgccaccaagcgcgccgtcacacttgcctgcagcttgcttgccggcgtcactgttggcttgcagctggcccgctgctgtctgccgcctcccgtgcacgcccgcgcagtgtcacgccatcgccatctactgtgcgtgtcacgacatcggctcggaacacaagtcaacccaaaagatcggaccgaccatgtacccacagagtgtgtggacccggtagtcagagaccgggccacgagcatcgatcctggagaagccacgctatacatctcgccttcagctgcaggtcgaagcgatggagaagcagaatatcgactttggcaaggtcttaatggagattcaggagtcgcttgtctcgctgaatcgggcgcaaggcgagacgcaaccgccgtcaacaagctggaccaaggcgtgaccaactggagaccgcaagtagaagcggcagtgaaggagttgcgtgaggaggtgggtgatatccgccagcaaatggacctgctcggcaaatcgcagtccgcgccgccggcgacgtcttcccctcgagttccgttgacggacgaggaaaggaaggcgccgttgcttcctacgccaccagcttcgcgcgtggctgcggcgggggacagcggagacaagtgggccagtggccgccaacatccacatgaacaccggggaagggcaccaggtgtggttaccaccgtggtcccgacctcggtcaagggtacgttcagttcacctgctccatctttgggaattttggattgggaaaatgattttgattcgggagagcgtaggtttaaccatagagtccctaagttagatttcccaaaatttgatggttcagatccacatgattggagaatgaagtgtgagcattactttgatgtgaataacacttatccagggttgtgggttagagtctctatcatttacttttctgggagggctgcttcgtggctgagatcaactagagctcacttgcggttccctaattgggaggatttttgcgctgcagtatctgataagtttgatagagaccagcatgattcgctaattagacagatggatcaaattaaacagacgggttcggtttgggagtattatgaacgattcgatgaattgatgaatcaattgctagtttatgatcctggggtaaatatgtgttacttgacacatagatttattgatgggttgcgtcgggagattagaaatgctgttttacttcagagacccaagaatctcgagtctgctctggctgttgcttccttgcaggaggaagtgttggaatcatctgactccacaccggtgaaggagggcaagaagtttgagagttctgggcagcacaagactggtggaaattttaagggagcttttcctttaccattgcctcctggtcgtcatttgggggtaattcagagtgcaagagtggatgagaagaaggaaggggaaattaaaagattgtctgcatcttcagagaaagtgtcagctcttaaagcacagcgtcgggcacaaggattatgttacatatgtgctgagaaatggtctcccactcataagtgtgctaacactgtgcaattgcatgcagttcaggagctgttttctgttttgcatgaagcttgtgatgaggcagtttgcaatcctgagaattctgttttatcggacagtcaggtgttgatggcaatctctgtacatgcagttcaaggatctgaagctagtggatgcatgaggatgttgggtcagattcaaggcaaggacgtttttattttggtagattctggtagcactgcaagtttcattagtgctcgagtggcagaagggttatcggaactttctcagattgctactaatttgcaagtgaaggtggctgatggagctactttgcactacctggaaccttcagaagaatttcctcttgcagtacaacaggtgctaaataaatttgcttcagtatttgaggaacctcagggtctgccacctgtgagatcgtttgatcacaccattcctttaatccctggagcaatgcctgtcaacgtgaggccttaccgttatactccatcccagaaagatgagattgagtctcaagtccaagaaatgctgtctaagggattgattcagcccagctcaagtccattctcttcacctgtgctgttggataagaagcacttgacttatcctaaagtaccagtatggatgccacctccagaagattgcgtaaagataaatgtggatgcagcaatatcacgatggggtaacaagggagctgttggggcagtgtgtcatactgtatctggtgaatttgtggcagccagtgctatggtctgggaagggctctctgactcggcaactttggaagcacttggatgcaatgaaggcttggcaatagctatgggctgtaatatgtcagagggccgcggcctccgccgcctgctctacctcgaccgcctccgcgacgactccgaggaggtccggtccggctacatcgaggagctcgcgggctccttccgcgtcctcgcctgcttcctcctcccctgcacgctcgccgaggccgcctacaaggcgtactggtacctcgccgcgccgccgttccgctccccgtggtggtccgccgccgcgtgcgccgtcgaggtcgcctcctgggcctaccgcaccgccgtcttcttcatggtctgcgtcctcttccggaccatctgctacctgcagatcctccggatgaagggcttcgcgcgcgagttctgcaggttcgccgacgtcgccgccgtgctcgagagccaccgccgcatcaggaagcagctccacaggatcagccaccgctaccgccgcttcatactctgctgcctcgtcctcgtcaccaccagccagttcgccgccctgcttgccaccaccaggccgcacgcgcagatcaacctcgccaccgccggcgagctcgcgctctgctcgctgagcctcgtggccgggctgctggtgtgcctccagagcgcggcgaagatcacgcacaagacgcaggcgatcacgagcgtggcggcggggtggcacgccgacgccaccatcaacgccttcgacaacgaccaggaggaccccaacccggacctcccccgcatcgtcggctacctggtgcccgtgaacgcctactggatggcctccggcgagtcctcgtcggactcctcctcctcctcctcctccagcgacgacgacgactccggccaccccaagtccaagtacatccctttccagaacaaccactgcttccagcagaggcaggcacttgtgacgtacctggagaacaaccgggccggcatcacggtgtacggcttcgtcgtcgaccggacgtggctgcacgcgctgttcatgatcgagttctccctcgtcatgtggctgctggggaagacggtcggcatatcctga

SEQ ID NO: 156 - protein, 1160 aa, Oryza sativa
MERSSGGGMEKEESTAGAGRRRRGGGAGGVSATKRAVTLACSLLAGVTVGLQLARCCLPPPVHARAVSRHRHLLCVSRHRLGTQVNPKDRTDHVPTECVDPVVRDRATSIDPGEATLYISPSAAGRSDGEAEYRLWQGLNGDSGVACLAESGARRDATAVNKLDQGVTNWRPQVEAAVKELREEVGDIRQQMDLLGKSQSAPPATSSPRVPLTDEERKAPLLPTPPASRVAAAGDSGDKWASGRQHPHEHRGRAPGVVTTVVPTSVKGTFSSPAPSLGILDWENDFDSGERRFNHRVPKLDFPKFDGSDPHDWRMKCEHYFDVNNTYPGLWVRVSIIYFSGRAASWLRSTRAHLRFPNWEDFCAAVSDKFDRDQHDSLIRQMDQIKQTGSVWEYYERFDELMNQLLVYDPGVNMCYLTHRFIDGLRREIRNAVLLQRPKNLESALAVASLQEEVLESSDSTPVKEGKKFESSGQHKTGGNFKGAFPLPLPPGRHLGVIQSARVDEKKEGEIKRLSASSEKVSALKAQRRAQGLCYICAEKWSPTHKCANTVQLHAVQELFSVLHEACDEAVCNPENSVLSDSQVLMAISVHAVQGSEASGCMRMLGQIQGKDVFILVDSGSTASFISARVAEGLSELSQIATNLQVKVADGATLHYLEPSEEFPLAVQQVLNKFASVFEEPQGLPPVRSFDHTIPLIPGAMPVNVRPYRYTPSQKDEIESQVQEMLSKGLIQPSSSPFSSPVLLDKKHLTYPKVPVWMPPPEDCVKINVDAAISRWGNKGAVGAVCHTVSGEFVAASAMVWEGLSDSATLEALGCNEGLAIAMGCNMSEGRGLRRLLYLDRLRDDSEEVRSGYIEELAGSFRVLACFLLPCTLAEAAYKAYWYLAAPPFRSPWWSAAACAVEVASWAYRTAVFFMVCVLFRTICYLQILRMKGFAREFCRFADVAAVLESHRRIRKQLHRISHRYRRFILCCLVLVTTSQFAALLATTRPHAQINLATAGELALCSLSLVAGLLVCLQSAAKITHKTQAITSVAAGWHADATINAFDNDQEDPNPDLPRIVGYLVPVNAYWMASGESSSDSSSSSSSSDDDDSGHPKSKYIPFQNNHCFQQRQALVTYLENNRAGITVYGFVVDRTWLHALFMIEFSLVMWLLGKTVGIS

SEQ ID NO: 157 - DNA, 1614 bp, Oryza sativa
  CDS (1)..(1614)
atggtggggcggagctccctcccggagggttccctcttcctcggattcgacagctccactcagtccctaaaagctaccgtgctgaacaacgaattgataatagtagcttcagatattgttaactttgattctgacttaccgcactacaaaacagaaggtggtgtttacagagatcctgcagatgatggccacatattttcaccaacaataatgtgggttgaagcctttgaattgctacttgagaagctaaagccaaagatcaactttagcaaggttgtggccatttcagggagtgggcaacaacacggcagtgtttattggaagaagggtagtcatgcggtgttgtcttccttggatcctactaagagcttgttatcccagctgaaggatgccttttctaccatggactcaccaatatggatggacagtagcacaactaagcaatgcagagaaatagaaagtgtagtaggcggcgcattggagctatcaaagttgacaggatctcgtgcctatgagaggttcactgggcctcagatccggaagatataccgaacagttccgcaagtttatgatgatactgagagaatatctttggtgagttcgttcatggcatcaatcctggtggggaactatgcaagtattgatgagactgatggtgctgggatgaacttgatggatataaaccagagaacctggtcaaagactgttttagaggcaacggctcctgggcttgaagagaagcttggaaagttggcaccagcatatgcagtagctggtcgaattgctccttattttgtagaaaggcttcagtttgataagaattgcttagttattcaatggtctggagacaatcccaatagccttgcaggtttaactctgaatactcctggtgaccttgcaattagccttggtactagtgatactgtttttgggataactgctgaagctaaaccaagtcttgaaggccatgttttccctaaccctgttgaacctgatggttatatggtgatgctgtgctacaaaaatggttcattgacccgagaaggcggaaaattaggattctactacaaagaccatgaaattctgccgccacttccagttggcttccatcgatacattgttgaaaacctcaatgatgtcacatccaacaatctggtggaacgtgaggtggaagaatttgatccaccatctgaggttcgcgccataatcgaaggccagctgctgtcaatgcgaggccatgccgagagattcggcatgcctaaccctcccaagcggatcatcgcaaccggtggcgcatcctccaacgagcgcatcctccactcaatcgcgcagatctttggctgtcctgtctttacagttcagagacctgattctgcctcgcttggcgcggcactgagagctgcccatggctggctgtgcaatgaggaagggagcttcgtccccatctcctgcatgtaccagggtaacctggagaagacctccttgggtgcaaagctcgccgtctcaaccggagagggtgtggaggacaaggagctcctggagaagtacacggtgctcatgaggaagaggatggagattgagaggcggctggtggagaagattgggcgcgcgtag

SEQ ID NO: 158 - protein, 537 aa, Oryza sativa
MVGRSSLPEGSLFLGFDSSTQSLKATVLNNELIIVASDIVNFDSDLPHYKTEGGVYRDPADDGHIFSPTIMWVEAFELLLEKLKPKINFSKVVAISGSGQQHGSVYWKKGSHAVLSSLDPTKSLLSQLKDAFSTMDSPIWMDSSTTKQCREIESVVGGALELSKLTGSRAYERFTGPQIRKIYRTVPQVYDDTERISLVSSFMASILVGNYASIDETDGAGMNLMDINQRTWSKTVLEATAPGLEEKLGKLAPAYAVAGRIAPYFVERLQFDKNCLVIQWSGDNPNSLAGLTLNTPGDLAISLGTSDTVFGITAEAKPSLEGHVFPNPVEPDGYMVMLCYKNGSLTREGGKLGFYYKDHEILPPLPVGFHRYIVENLNDVTSNNLVEREVEEFDPPSEVRAIIEGQLLSMRGHAERFGMPNPPKRIIATGGASSNERILHSIAQIFGCPVFTVQRPDSASLGAALRAAHGWLCNEEGSFVPISCMYQGNLEKTSLGAKLAVSTGEGVEDKELLEKYTVLMRKRMEIERRLVEKIGRA

SEQ ID NO: 159 - DNA, 1647 bp, Oryza sativa
  CDS (1)..(1647)
atggacaagaacggcagcagctacggcgagagctcgtcggacgacgtggaggcgccgctgctgctgccggcggcgaggggcgggacgatggcgaagggtgatcgtcgacgtccggcgtcgtcggcggcggcggcgtgggtgcgcgctctgctcgcgcacaagtacccggcgatcgcggcggggccggcggcgtgcgcggcggtgtgcgccgccgtggacctcggggacgggcacggcgaggcgcggaacatgctgggcgtgctggcgtgggtgttcctctggtgggtcaccggcgccgtgccgctcgccgtcgcgtccatggcgccgctgttcctcttcccggccctggggatctcctcctccgacgacgtcgccagggcgtacatgggcgacgtcatctccctcgtcctcggcagcttcatcctcgccctcgccgtcgaccaccaccgcatccaccgccgcctcgccctcaacgtgctgtccctcttctgcggcgatccggtgcggccgtcgctgctgctcctcggcgtcaccggcacgaccgcgctcgtcagcatgtggatccacaacacggcgtgcacggtcatgatgatgccggtggcgacggggatcctgcagaggttcccccgcggcgacatcgacgacggcggcgggcaggaggtgcggcgattctccaaagcggtggtgctcggcgtggtgtacgcgtcggcgatcggcggcatggcgacgctgaccggcaccggcgtgaacatcatcctggtggggatgtggtcgtcctacttcccggagcagaggcccatcaccttcagctcatggatgtccttcggcctccccatggcgatcatcctcttcctcgcgctctggctcaccctctgcctcatgtactgctccaacaacaccgccaaggccctctccgcctacctcgacagaagccatttgagacgagagctcagcttgttaggtccaatggcttttgcagagaagatggtcttggctgtgtttgggggcctagttgtgctgtggatgagtaggaacataacagacaacatccctggatggggagttcttttccacaataaagttggggatggcacagttactatcatgatggccacccttctgttcataatccccagcgggaagagggagggtgagaagctgatggactggaacaagtgcaagaagatccagtggaacatcatccttctcctcggcgcaggattcgccattgccgatggcttcaagacgagcggcctcaccgacatcctctccaacggcctcaggttcctgaaaggggcgccgacgctggtgatcgtgcctgtcgcctgcgttttcagcgggatcatgacagagttcacttctgacgactcaaccacgacgctggtgctgccattgttcgctgaacttgccaaatccattgaggtgcaccctgccttgctcatggtttccggcgcaatcggggcccagttgtcatacttgttgcccaccggatcgccgtcaaacgttgtcggcttcagcaccggctacattaccatcaaggatctggtggccactgggttgcccctgaaaattgttgccattgcagctctgacagtcttactgccaacattaggtaacattcctgcacagatcaacattaaggattag

SEQ ID NO: 160 - protein, 548 aa, Oryza sativa
MDKNGSSYGESSSDDVEAPLLLPAARGGTMAKGDRRRPASSAAAAWVRALLAHKYPAIAAGPAACAAVCAAVDLGDGHGEARNMLGVLAWVFLWWVTGAVPLAVASMAPLFLFPALGISSSDDVARAYMGDVISLVLGSFILALAVDHHRIHRRLALNVLSLFCGDPVRPSLLLLGVTGTTALVSMWIHNTACTVMMMPVATGILQRFPRGDIDDGGGQEVRRFSKAVVLGVVYASAIGGMATLTGTGVNIILVGMWSSYFPEQRPITFSSWMSFGLPMAIILFLALWLTLCLMYCSNNTAKALSAYLDRSHLRRELSLLGPMAFAEKMVLAVFGGLVVLWMSRNITDNIPGWGVLFHNKVGDGTVTIMMATLLFIIPSGKREGEKLMDWNKCKKIQWNIILLLGAGFAIADGFKTSGLTDILSNGLRFLKGAPTLVIVPVACVFSGIMTEFTSDDSTTTLVLPLFAELAKSIEVHPALLMVSGAIGAQLSYLLPTGSPSNVVGFSTGYITIKDLVATGLPLKIVAIAALTVLLPTLGNIPAQINIKD

SEQ ID NO: 161 - DNA, 1101 bp, Oryza sativa
  CDS (1)..(1101)
atgtcgtgccagatctgccaaaaaacgcgatccacggaggcgcaaggcggcggggcccagccgaagcgggcagcgctgcgccaccacacgcgaacacccccaccacctctccctttccttcccatcccattccccgcaagtctccctctcgcaccacaacaaacgcgcctcctccatctcgaactctccagtctccaccacccccgtccccgtctctcgatcgccatggcctccggcctcgccggctccaccgccgtctgctcctctcccctcgcatccgcctccgcctccgcttcgtccgcgcgccggctgggcgcggtcccgccctcccgcgggatccgctaccaggccctccgcgcggactccggtttcgccgggaaccgccggggtggcggccgtggagcgtcggtagtgtgcgcggtccagggccaggacacatccatccaaggtatgcacgccggtcttctgctcgtgctgaatctgactagtttagatgctgaatttgtgttgggactcggtcatttaggcgtagttcctctatggcagcatgtcgaagtgacgaagtcaacatggcaatcacttgttatggagagcgagcttcctgtccttgttggatactgggctacatggtgtgggccttgcaaaatgattgatcccgttgttggcaagctctccaaggagtatgaagggaaactgaaatgctacaagctcaatactgacgagaatccagatatagcaagtcagtatggcgtccggagcatcccaaccatgatgatattcaagaacggagagaagaaagatgcagtgattggagctgtgcctgagagtacactgatcgcatccattgagaaatttgtcgagaggttgaatgatgaaatcatgaaagtcgcaaggaagcctgatctagatgccgatgagggtggcgacagtggtgcacgactgaggcaatcactcgacactcctcgcgggtacaggagacagcatcggcaacaacacaagcagctaaggcacatcacttcaaatggtggcgtcgatatgcttggaggtgatgtcgcaatgtcatcacctttgcgcttatctttagttgtggttttttgctag

SEQ ID NO: 162 - protein, 366 aa, Oryza sativa
MSCQICQKTRSTEAQGGGAQPKRAALRHHTRTPPPPLPFLPIPFPASLPLAPQQTRLLHLELSSLHHPRPRLSIAMASGLAGSTAVCSSPLASASASASSARRLGAVPPSRGIRYQALRADSGFAGNRRGGGRGASVVCAVQGQDTSIQGMHAGLLLVLNLTSLDAEFVLGLGHLGVVPLWQHVEVTKSTWQSLVMESELPVLVGYWATWCGPCKMIDPVVGKLSKEYEGKLKCYKLNTDENPDIASQYGVRSIPTMMIFKNGEKKDAVIGAVPESTLIASIEKFVERLNDEIMKVARKPDLDADEGGDSGARLRQSLDTPRGYRRQHRQQHKQLRHITSNGGVDMLGGDVAMSSPLRLSLVVVFC

SEQ ID NO: 163 - DNA, 831 bp, Oryza sativa
  CDS (1)..(831)
atggcaacaactaccgtcaccacaccaattctctgcaacctcagcgccaagccacgcgacaccctgcgcctgccgacgacgcgttcgccgaacgacggcacgaggcgaacgacgctccacctgagctcgtcaagagcccgcggcgacttgatccgcgccgccgccgccgtctacacggtgaagctcatcgggccggaggggcaggagagcgtgatcaaggtgccggaggacacctacatcctggacgcggccgaggaagccggcgtcgacctgccctactcgtgccgcgccggcgcgtgctccacctgcgccggcaaggtcgtcgagggcggcgtcgaccagtcggaccagtcgttcctcgacgacgcccaggtcggcgccggctacgtgctcacctgcgtcgcgtacccgaccgccaacagcgtcatccagacgcacaaggaggcagacctgtattatagtcccggggcccaggatccacgtgccgccgactcggaacggcgtcaccacgcggccacaccgggccgcgtcgatcgccaccgccccatcaccgcgcaccgacgcctctgccccgccacgccccgcgtggcggccgccgcgccacggcggaaaccaatcggaattcgggaacctcgcggccgggccggcgcgcgccgtattttcgtcgtccgtccgattttcgctgaaatgcgcggggaggtttcgtgccgcgggcggaagtttcgatcgcagcagccgcccggcgcgcgcgtcaccgtccgcaaccgccacccggaaagggcatcccagggccggggtgcacggaactgcttctgcgagctgagctggtag

SEQ ID NO: 164 - protein, 276 aa, Oryza sativa
MATTTVTTPILCNLSAKPRDTLRLPTTRSPNDGTRRTTLHLSSSRARGDLIRAAAAVYTVKLIGPEGQESVIKVPEDTYILDAAEEAGVDLPYSCRAGACSTCAGKVVEGGVDQSDQSFLDDAQVGAGYVLTCVAYPTANSVIQTHKEADLYYSPGAQDPRAADSERRHHAATPGRVDRHRPITAHRRLCPATPRVAAAAPRRKPIGIREPRGRAGARRIFVVRPIFAEMRGEVSCRGRKFRSQQPPGARVTVRNRHPERASQGRGARNCFCELSW

SEQ ID NO: 165 - DNA, 2262 bp, Oryza sativa
  CDS (1)..(2262)
atggaagtctcatggcacaaggaggcctccctcaatgttggcgatgtccttgagccgcccaggactggtattgctgctaaggtgctcaagtcaatgggcataaatctcaaggatgcacgtgtggaagtggagaagatcattgggaggggcaatggtttcgttgctgtcgaaataccattcacaccacgtgcaaaacgtgttttggagctttcattggaagaagctcgtcagctaggacacaactatattggatctgagcacttgcttcttggactgctccgtgagggtgaaggtgtagcagcccgtgtgctcgaaagccttggagccgatcctagcaatattcgcacgcagggaaagctagatcctgttgttggaaggcaaccccagattgagcgtgtcgtacaaattctgggcagacgaacaaagaacaacccatgcttaattggagagcctggtgttggaaagacagcaattgcagaaggccttgctcaacgcatttctactggtgatgtgcctgaaacaattgaaggaaagaaggtcattacccttgatatgggacttcttgttgctggtacaaaataccgtggagaatttgaagaaagattaaagaagctgatggaagaaatcaagcagagtgatgagataatactatttattgatgaagtccacactctcataggagcaggagcagctgagggtgctattgacgctgctaacattttaaagccagcattagcaagaggagaactacagtgtattggagccaccacacttgatgaatacaggaagcatattgagaaagacccagcattagaaagacgtttccagcctgtaagagtgccagagccaacagttgatgaaaccatagaaattctcagagggcttcgggaacgatatgagatccatcataaacttcgttacactgatgatgctctgatttcagctgccaagctatcttatcaatacatcagtgatcgtttcctcccagataaagcaattgatttgattgatgaagcaggttcacgtgtaaggcttcgacatgcccaggttcctgaagaagctagagagcttgacaaggagctcaagcaaatcacaaaagataagaatgaagctgtccgtagccaggacttcgaaaaggctggagagttacgtgatcgtgaaatggaattgaaggcccagataacagctctcattgacaagagcaaggagatgagcaaagcagagactgaatcaggggagacagggccactggtcaatgaagcagatatccagcacattgtatcctcgtggactggtattccagtagagaaggtatcaagtgacgagtccgataagcttcttaagatggaagagactttgcatcagcgtgtcattggtcaagatgaggctgtgaaagccataagtcgctccatccgccgtgctcgtgtgggcctcaagaacccgaacaggccgattgcaagcttcattttcgcaggtccaaccggtgttggtaaatccgagctcgcaaaagcacttgcagcatattactttggatctgaggaggccatgatcaggcttgatatgagtgaattcatggagaggcacactgtatccaagttgattggttcacccccagggtatgttgggtacacggagggtggacagctgactgaggcagttcgacgcaggccatacacagtcgtgcttttcgacgagatcgaaaaggcgcatccagatggaagaacagtggacttcaagaacacacttctcataatgacttcgaacgtcggaagcagcgtcatcgagaagggtggtcggaagataggtttcgatctcgattacgatgagaaggacagcagctacagcaggatcaagagccttgtcgtcgaggagatgaagcagtacttccgccccgagttcctcaaccgtctcgacgagatgatcgtcttcaggcaactcaccaagctggaggtcaaggagatcgccgagatcatgctcaaggaggtctttgacaggctcaaggccaaggacattgacctccaggtcaccgagaagttcaaggagcgtatcgttgacgaaggcttcaacccgagctatggtgcgaggccgctaaggagggccatcatgaggctcctggaggacagcctcgcggagaagatgctagctggggaggtgaaggagggtgattctgccattgtcgatgtggattccgaggggaaggtgattgtactgaatggccaaagtgggttgcctgagctttcaactccggctgtcactgtgtag

SEQ ID NO: 166 - protein, 753 aa, Oryza sativa
MEVSWHKEASLNVGDVLEPPRTGIAAKVLKSMGINLKDARVEVEKIIGRGNGFVAVEIPFTPRAKRVLELSLEEARQLGHNYIGSEHLLLGLLREGEGVAARVLESLGADPSNIRTQGKLDPVVGRQPQIERVVQILGRRTKNNPCLIGEPGVGKTAIAEGLAQRISTGDVPETIEGKKVITLDMGLLVAGTKYRGEFEERLKKLMEEIKQSDEIILFIDEVHTLIGAGAAEGAIDAANILKPALARGELQCIGATTLDEYRKHIEKDPALERRFQPVRVPEPTVDETIEILRGLRERYEIHHKLRYTDDALISAAKLSYQYISDRFLPDKAIDLIDEAGSRVRLRHAQVPEEARELDKELKQITKDKNEAVRSQDFEKAGELRDREMELKAQITALIDKSKEMSKAETESGETGPLVNEADIQHIVSSWTGIPVEKVSSDESDKLLKMEETLHQRVIGQDEAVKAISRSIRRARVGLKNPNRPIASFIFAGPTGVGKSELAKALAAYYFGSEEAMIRLDMSEFMERHTVSKLIGSPPGYVGYTEGGQLTEAVRRRPYTVVLFDEIEKAHPDGRTVDFKNTLLIMTSNVGSSVIEKGGRKIGFDLDYDEKDSSYSRIKSLVVEEMKQYFRPEFLNRLDEMIVFRQLTKLEVKEIAEIMLKEVFDRLKAKDIDLQVTEKFKERIVDEGFNPSYGARPLRRAIMRLLEDSLAEKMLAGEVKEGDSAIVDVDSEGKVIVLNGQSGLPELSTPAVTV

SEQ ID NO: 167 - DNA, 1227 bp, Oryza sativa
  CDS (1)..(1227)
atgcaggtgcagatgcgcctccaccccgccgcggcggcggaggaggaggacgccgacctcccgctccccgccctcttcgacaaggcgtcccacctccactccctcgcctccagctcctccctcgaccaggaagggatccgcaagggggtcgacctgctgcggcggtgcgacgagatggtcagtaaggtcggcctcttctcctccaacgagaccaaggatgacatctccaccgccaacctcaaatacctactcgtaccgtactaccttggggaaatgactgaaagggtagcgcaggaagatcggatcccagtccttaaggcgtcgcaggatcatttgaaggaattcatttctatctgtgaagcactggagcttatatcagaggatgagcttgaaatatctaggcagaagcaacctgataccatggcaaatcgaagagcacagaaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggcatggttagctactatctcattggctctatgcaaggcttttgaccttcttgacatgttaaagaaggaagaagaaatgcttccggcagtaaaagaaaggaaagcgaaggatggtaatgcatttgctcgtgaaatgcttgatgaacgtacaaaaagggctgaagcatggcaccataatgctgccaaccgtgcaccatactccaaaccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttataggttgccaacgatgagcatagaagaagctggcttacgtgagatgaaaatgatggagaaatggcaagaaagaactgccaagatgattcaagaatcaaactccgcatggcacaaggatggcagtcggtcagcccaagaggacgaggacgccgaagaggagaaagcgagaggatgggatgactggaaggacgataaccctcgtggtgcaggcaacaagaagctcactccctgtggctaa

SEQ ID NO: 168 - protein, 408 aa, Oryza sativa
MQVQMRLHPAAAAEEEDADLPLPALFDKASHLHSLASSSSLDQEGIRKGVDLLRRCDEMVSKVGLFSSNETKDDISTANLKYLLVPYYLGEMTERVAQEDRIPVLKASQDHLKEFISICEALELISEDELEISRQKQPDTMANRRAQKVARFKRQKAAETKLLEIKERKERRRRSLRAAALSAPIEAGEEDAFEDDGEEEREAWLATISLALCKAFDLLDMLKKEEEMLPAVKERKAKDGNAFAREMLDERTKRAEAWHHNAANRAPYSKPADPITCATFAQDVIEGRASVSQAHEHKHQPLIFGPASLVGGGLTSERERMAAQVFQPSYRLPTMSIEEAGLREMKMMEKWQERTAKMIQESNSAWHKDGSRSAQEDEDAEEEKARGWDDWKDDNPRGAGNKKLTPCG

SEQ ID NO: 169 - DNA, 660 bp, Oryza sativa
  CDS (1)..(660)
atggcgtcggtgcagctgtccgccggcccgcgggtgtcagtgtcaccggcggcggcgctggtggcgatgccttcggtcgccgccgccgcatcgagggggcgccgcgggtaccgggggctcgtcgtgagggccgccacggtcgtgtcgcccaagtatacttctatcaaacccttgggagatagggtgcttgtgaagatcaagacctctgatgataaaactgttggaggaatattacttccaacatcagttcagtcaaaaccgcaaggaggacaagttgtagcagttggagaggggagaagcatgggcagcgacagcatagagatcagtgttccagttggtgcacaagttgtctactctaaatatgctggcacagagttggaattcgatgggtctgaccatctcattttgaaagaagatgacatcattggtattctcgacacagatgatgtgaaagatctgaagccactgaatgaccgtgttctcattaaggtgacagccgtaggcccaggaccattggttgaggatggcagcaggaaacccttgtcaatcactcctgggaataccgtgatgtactccaagtacgcgggaagcgagtttaagggtgaagatggcgaatatattgttctcagggtatccgacgtaatggctgttctttcctaa

SEQ ID NO: 170 - protein, 219 aa, Oryza sativa
MASVQLSAGPRVSVSPAAALVAMPSVAAAASRGRRGYRGLVVRAATVVSPKYTSIKPLGDRVLVKIKTSDDKTVGGILLPTSVQSKPQGGQVVAVGEGRSMGSDSIEISVPVGAQVVYSKYAGTELEFDGSDHLILKEDDIIGILDTDDVKDLKPLNDRVLIKVTAVGPGPLVEDGSRKPLSITPGNTVMYSKYAGSEFKGEDGEYIVLRVSDVMAVLS

SEQ ID NO: 171 - DNA, 1833 bp, Oryza sativa
  CDS (1)..(1833)
atggcggcgcaaatggcggcggtggcggtgaacgggggctctccgggggctgtcaccgcggcggcggcggcgggaggggtcggcgtcgccgtgggcctcgggggcggcggggcgcagtcgctgtacgtgggcgacctggaggcgtcggtcacggactcgcagctgtacgagctcttcagccaggcggggcaggtgatgtcggtgcgcgtctgcagggacatcagctcgcgccgctcgctcggctacgcctacgtcaacttcaacaaccccgtggatgctgcaagagcactggagctgctcaactttgctcctctgaatggcaaacccattcgggtaatgtactcaaaccgtgacccaagcagtcgcagaagtggatctgctaacattttcatcaagcctgtttatgttggaccttttctccgcaagcaagagagagagaattctgttgacaagacaaagtttaacaatgtttttgtgaaaaatttgtctgagtccaccacaaaggaggatctagtcaaaatttttggtgcctatgggaacatcacaagtgctgttatcatggttggcatggatggtaaatcaaggtgctttggtttcatcaattttaagagcccagatgatgctgctcgtgctgttgaggaacttaatggaaagaaaattaatgacaaagaatggtatgttggaagagctcagaagaagtcagaaagagagattgaattgaagagaagatttgagcaaagcatgaaagatgctgctgacaaatatcaaggactgaacttatacatgaagaatttggatgatagcattggggatgaccagctttgtgaattgttctctaactatggcaaaattacttcatgcaagataatgcgtgatgcaaatggtgttagcaaagggtctggatttgttgcattttcaactcgtgaggaagcatctcaagctctattgtatatcactgtggcttacatagttccttttatacagttaactgaaatgaatggcaaaatgatatctggaaagccattgtatgtcgcatttgcacaacgtaaagaagacaggaaggcgatgttgcaggcacaattttctcaggtgcgccctgtaccgatgacaccttccatggctccacgtcttcccatgtaccctcctatggctcctcttgggcagcaactcttctacggacaagctccacctgctatcatgcccccacagcctggatttggtttccagcaacagcttgttccaggcatgaggcctgggggtgcccatatgccaaattactttgttccagttgtccaacaaggtcaacagggtccacgtccaggtatccggcgttctggtgctggttctgcccagggacagcaatctgctcagccatttcagcaacagatgcttccaagaggacgtgtgtaccgttacccacctgcgcataacatgcctgatgttccaccaatgccgggggttgctggtggtatgattcaatcgtatgatatgggaggcttcccagtacgagatgctggtttgtcacctgctccaattggaacgctgacttctgcccttgcaaatgctaatccagaacagcaaagaacgatacttggtgaaagcctgtatccactggttgagcttctggaacagaaccatgcggccaaggtcaccggaatgcttctggagatggatcagacggaggtcctgcatctgctcgagtctccagaggctctgaagtccaaggttgctgaggcgatggatgtcctccgcaatgtggcccagcagcacaatgcgaacaccccgaccagtcaacttgctgcgctgtcactgggcgacgccattatctcctaa

SEQ ID NO: 172 - protein, 610 aa, Oryza sativa
MAAQMAAVAVNGGSPGAVTAAAAAGGVGVAVGLGGGGAQSLYVGDLEASVTDSQLYELFSQAGQVMSVRVCRDISSRRSLGYAYVNFNNPVDAARALELLNFAPLNGKPIRVMYSNRDPSSRRSGSANIFIKPVYVGPFLRKQERENSVDKTKFNNVFVKNLSESTTKEDLVKIFGAYGNITSAVIMVGMDGKSRCFGFINFKSPDDAARAVEELNGKKINDKEWYVGRAQKKSEREIELKRRFEQSMKDAADKYQGLNLYMKNLDDSIGDDQLCELFSNYGKITSCKIMRDANGVSKGSGFVAFSTREEASQALLYITVAYIVPFIQLTEMNGKMISGKPLYVAFAQRKEDRKAMLQAQFSQVRPVPMTPSMAPRLPMYPPMAPLGQQLFYGQAPPAIMPPQPGFGFQQQLVPGMRPGGAHMPNYFVPVVQQGQQGPRPGIRRSGAGSAQGQQSAQPFQQQMLPRGRVYRYPPAHNMPDVPPMPGVAGGMIQSYDMGGFPVRDAGLSPAPIGTLTSALANANPEQQRTILGESLYPLVELLEQNHAAKVTGMLLEMDQTEVLHLLESPEALKSKVAEAMDVLRNVAQQHNANTPTSQLAALSLGDAIIS

SEQ ID NO: 173 - DNA, 990 bp, Oryza sativa
  CDS (1)..(990)
atggccgccgactaccgcacacccgaccgcctcctctccgccgccgcccccggcgaggagcaggcgcaggatccgcccaagccggtgctcgccgtcgccgcgacccatgacggcctccggttctggcagtacatgctcgccggctccgtcgccggcgtcgtcgagcacaccgcgatgttccccgtcgacacgctcaagacgcacatgcaggccggggcgccgccctgccgcccggtcctgtcgctgggggcggtgctgcgcgccgccgtgtccggcgagggcggcgtcagggcgctgtaccgcggcctccccgcgatggcgctcggcgccggccccgcccacgccgtctacttctccgtctacgagttcgccaagtcgcggctctccgaacgcctgggccccaacaaccccgccgcgcacgccgcatcgggggtgctcgccaccatcgccagcgacgccgtgttcaccccgatggacaccgtcaagcagcggctgcagctcacgagcagcccgtacacgggcgtctcgcactgcgtccggaccgtgctccgtgacgagggcctcggcgcgttcttcgcgtcctaccggaccacggtggtgatgaacgcgccgtacacggcggtacacttcgctacctatgaggcggcgaagcggatgctcggggacatggccaccaacgaggattcgctcgccgtgcacgccaccgccggagccgcagccggcgcgctcgcggctgcagtcacaacgccgctcgacgttgtcaagactcagctgcagtgtcagggtgtgtgcggctgtgagcgcttctcaagtagctcaataggtgatgtattcagaacaatcataaagcgtgatggatatgctgggcttatgagaggatggaagccaagaatgctgttccacgcacctgcagctgctatctgctggtcgacgcctgctagtgatccatgtggaatgatgtactgtgcatcaaaacatgtccaaagatag

SEQ ID NO: 174 - protein, 329 aa, Oryza sativa
MAADYRTPDRLLSAAAPGEEQAQDPPKPVLAVAATHDGLRFWQYMLAGSVAGVVEHTAMFPVDTLKTHMQAGAPPCRPVLSLGAVLRAAVSGEGGVRALYRGLPAMALGAGPAHAVYFSVYEFAKSRLSERLGPNNPAAHAASGVLATIASDAVFTPMDTVKQRLQLTSSPYTGVSHCVRTVLRDEGLGAFFASYRTTVVMNAPYTAVHFATYEAAKRMLGDMATNEDSLAVHATAGAAAGALAAAVTTPLDVVKTQLQCQGVCGCERFSSSSIGDVFRTIIKRDGYAGLMRGWKPRMLFHAPAAAICWSTPASDPCGMMYCASKHVQR

SEQ ID NO: 175 - DNA, 2208 bp, Oryza sativa
  CDS (1)..(2208)
atggggagaggagggatcggcggcgcggggctggtggcggcggtcgcgaaggcggacgtggagaacaccgactccacccgcggcttcgtcaaggacgtgaagcgcatcatcatcaaggtcggcaccgctgttgtgactgggccgaatggccggttggctatgggcaggctcggtgctctgtgtgaacaggtgaagcagctaaattttgaggggtacgaggtgattctggtcacctctggtgctgttggtgttgggaggcagaggctcaagtaccggaagctcgtcaatagcagtttcgctgatctgcagaacccacagatggacatggacgggaaggcctgcgctgccgtcggtcagagtgtgctgatggcgatctatgacacgttatttagccagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggattcatctggcatattctgggataacgatagtttggccagactgttagcgcaagaacttaaagctgatctccttatcatgctcagtgatgtggaggggctctatagcggtccacctagcgatccacaatcgaagattatccacacatacgtccatgaacaacatgggaagttaattagctttggggagaaatctcgtgtgggaagaggtggaatgcaagctaaagtagcagctgcttttactgcttcatcaaaaggaatacctgttgtaattgccagtggatttgcaatcgatagcattattaaggtcatgcgaggagagaaaatcggtacgcttttccatagggaagcaaaccagtggggttgttccaaggaagcaacagcgcgtgagatggccgttgctgcaagagattgctccagacatctacagaaattgtcgtctgaggagcgtaagaagattttgctagacatcgccgatgctctagaagcaaatgaagatctaattacatccgagaaccaagctgatctggatttggcgcaagatattggttacgataaatcattggttgctcggatgaccataaagccaggaaagataaaaagcctcgcaggatcaattcgtgaaatcgctgatatggaggaccctatttcccatacactgaaaagaacagaggttgctaaagatcttgtttttgagaaaacatattgcccattgggtgttctcctaattatttttgagtcccgtcctgatgccttggtacagattgcatctttagcaatccgaagtggaaatggtcttctcttgaaaggaggaaaagaagctatgagatcaaacacaatactgcataaggtcataactggtgcaattccagatgttgttggtaaaaaacttattggcctagtgaaaaacaaagatgaaattgctgatttgctcaagcttgatgatgtgattgatcttgtaataccaagaggtagcaataagctcgtttcccagatcaaagcagcaaccaagattcctgttcttggtcatgctgacggtatctgccatgtttatattgacaaatcagctgacatggacatggcaaaacgtattgtattggacgcaaaggttgattatccagcagcgtgtaatgccatggaaacgttacttgttcataaagatctgaacaggacagaaggccttgacgatttattggtggagcttgaaaaggaaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaagtgcacacacagattgcattatcactactgatggaaaggcagcagagacttttctacagcaagttgatagtgctgcggtattccataatgcaagcacacggttctgtgatggggctcgctttggtctaggtgctgaggttggcataagcacagggcgcatacatgctcgggggcctgttggcgttgatggactcctaacaactcgatgcattttacgaggaagtggacaagtagtgaacggcgacaagggagttgtttacacccacagggagctccctttgcagtga

SEQ ID NO: 176 - protein, 735 aa, Oryza sativa
MGRGGIGGAGLVAAVAKADVENTDSTRGFVKDVKRIIIKVGTAVVTGPNGRLAMGRLGALCEQVKQLNFEGYEVILVTSGAVGVGRQRLKYRKLVNSSFADLQNPQMDMDGKACAAVGQSVLMAIYDTLFSQLDVTSSQLLVTDRDFMDPSFGNQLRETVNSLLDLKVIPVFNENDAISTRRQPYEDSSGIFWDNDSLARLLAQELKADLLIMLSDVEGLYSGPPSDPQSKIIHTYVHEQHGKLISFGEKSRVGRGGMQAKVAAAFTASSKGIPVVIASGFAIDSIIKVMRGEKIGTLFHREANQWGCSKEATAREMAVAARDCSRHLQKLSSEERKKILLDIADALEANEDLITSENQADLDLAQDIGYDKSLVARMTIKPGKIKSLAGSIREIADMEDPISHTLKRTEVAKDLVFEKTYCPLGVLLIIFESRPDALVQIASLAIRSGNGLLLKGGKEAMRSNTILHKVITGAIPDVVGKKLIGLVKNKDEIADLLKLDDVIDLVIPRGSNKLVSQIKAATKIPVLGHADGICHVYIDKSADMDMAKRIVLDAKVDYPAACNAMETLLVHKDLNRTEGLDDLLVELEKEGVVIYGGPVAHDTLKLPKVDSFHHEYNSMACTLEFVDDVQSAIDHINRYGSAHTDCIITTDGKAAETFLQQVDSAAVFHNASTRFCDGARFGLGAEVGISTGRIHARGPVGVDGLLTTRCILRGSGQVVNGDKGVVYTHRELPLQ

SEQ ID NO: 177 - DNA, 1065 bp, Oryza sativa
  CDS (1)..(1065)
atggcagatgtcctaggatgttacactataaagtcccatggaaccaaagtggcgagacttcacatgtacgactggataatacttctactccttgctgttatagatggactgttgaacataattgaaccttttcaccgtttcgtcgggagggacatgatgactgacttgagatatccattgaagggcaatactgttcccttctgggctgttccgctcattggaattgtattgccttgtgccatctttggtggaatttacttcaaaaagaagaatttctatgatttgcaccatggcatactggggatcctatactctgtgcttataactgcggtaatcacagatgcaattaaggatggtgtgggtcgtccacgcccagattttttctggcgctgtttcccagatggaaaggataactcactgaaggaccttctttccaggtttatgataatgtcactactggtgtcatatgccatggagagaagagtgtcatcaaagaaggtcacaagagctttccaagcgggcactcttcatgagcttacgatcgctttgaggcctcaattgggcgtgggcagggacttcttaatgcagaagctagtttggtgcaatggtggttgggagccagccggcaatgtagataactatgcaaggtcttttgctggtctaggcttccttgcatggtacttagctgggaagatcacagtttttgatcgtagaggtcatgttgcaaagctatgcatagtatttctgcctcttcttactgctgcacttgtggctgtttctcgagtggatgactactggcatcactggcaggatgtatttgcaggctctctgataggtcttacagtcgcatcattttgttatctgcaattcttcccatatccttatgacgcagacgctttctggcctcatgcatacaccttccagctagcggaggcctcgcgcaacaataacaccgcaaactcctacagcgtgagaccgaccgggttcgagactgtcaatgtcccagaagggcatggtgggattgctctgagagacaccaacctagaggccggcaggagaccgtga

SEQ ID NO: 178 - protein, 354 aa, Oryza sativa
MADVLGCYTIKSHGTKVARLHMYDWIILLLLAVIDGLLNIIEPFHRFVGRDMMTDLRYPLKGNTVPFWAVPLIGIVLPCAIFGGIYFKKKNFYDLHHGILGILYSVLITAVITDAIKDGVGRPRPDFFWRCFPDGKDNSLKDLLSRFMIMSLLVSYAMERRVSSKKVTRAFQAGTLHELTIALRPQLGVGRDFLMQKLVWCNGGWEPAGNVDNYARSFAGLGFLAWYLAGKITVFDRRGHVAKLCIVFLPLLTAALVAVSRVDDYWHHWQDVFAGSLIGLTVASFCYLQFFPYPYDADAFWPHAYTFQLAEASRNNNTANSYSVRPTGFETVNVPEGHGGIALRDTNLEAGRRP

SEQ ID NO: 179 - DNA, 1737 bp, Oryza sativa
  CDS (1)..(1737)
atgactgaacaattatacactgtggcatctgacagtgaaaccactggggaagataagtcgcagatgtcgtttcctgatgttgctattggaatcgacattgggacctcaaattgtagtgttgccgtttggactggccatcaggttgaactcctcaaaaacactcgcaaccagaaagggatgaggtcatatgtgatgttcaaagatgacagcctttcagcaggagttacaggaggagcaacccgggaacatggacatgaggaaagagatattttgtcaggaagtgccatatttaacatgaaacgtttgattgggagaatggacacagatgaagtggttcaagctagcaagagccttccttttcttgtgcagacattgggtattggggtgagaccattcattgcagcactggtgaacaatatgtggcggtctaccactcctgaagaagttcttgccatctttctccttgaattgaaggccttggtagagatgcatctcaaacatccggtgaggaatgctgttcttaccattccagttgcattcagtcggtttcaacagaccaggattgagagagcatgtgcgatggctgggctgcatgtgttacggctcatgccagagccgaccgctatcgcacttttgtatgcccaacagcagcagcaattgctacatgacaatatgggaagtggcattgagaaaattgctctgatatttaacatgggtgctggctactgtgatgctgctgtggctgccactgctggaggtgtttctcagataagagcactttcaggaagcactgttggtggagaggatatccttcagaatgtcatgcgccatctcatgcctgattttgatagtctatatgctggtcaaacaatggacagaatcaagtcaattggcttactccggatggcaactcaggatgcaattcacaaactggctacgcaggagcatgtggagatcaatgtagatttgggggctggccacaaagtgtcaaagatcttggaccgtggagaatttgaaaaggtgaatcagtctatttttgagaaatgtgaagggatcatcaagcaatgcctggctgatgcaaagttaacaccagaggacatcaatgatgtgatattggttggaggatgttccagaattcctaaaatcagaagcgttgtccttggcttatgcaagaaggacgactcttacagtggtatagacccacttgaagctgcagtttcaggggctgctttggaaggagccattgcctcaggagtatctgacccttcagggagcctggatctgttgacaattcaggcaactccaatgaaccttggaattcgtgctgacggcggtaacttcgccgcaatcattccaaggaacactgctgttcctgcgagaagggacatgctctttaccacaacccacgacaatcagaccgaagctctcattgccgtctatgaaggcgaagggaatcaggctgaagacaaccatctattgggatacttcaagatcaccggtattccagcagcagcaaagggcaccgtcgaaatcaatgtctgcatggacatcgacgctggcaatgtcctcagggtattcgccggcgtcgtcaagcctcagggccaggctgttccaccgttcattgaggtgaggatgccaacgctagacgatggccatggctggtgcggacaggctctcgccaagatgtatggcagtacgcttgacctggctactatcccgaagaagctgcatccttga

SEQ ID NO: 180 - protein, 578 aa, Oryza sativa
MTEQLYTVASDSETTGEDKSQMSFPDVAIGIDIGTSNCSVAVWTGHQVELLKNTRNQKGMRSYVMFKDDSLSAGVTGGATREHGHEERDILSGSAIFNMKRLIGRMDTDEVVQASKSLPFLVQTLGIGVRPFIAALVNNMWRSTTPEEVLAIFLLELKALVEMHLKHPVRNAVLTIPVAFSRFQQTRIERACAMAGLHVLRLMPEPTAIALLYAQQQQQLLHDNMGSGIEKIALIFNMGAGYCDAAVAATAGGVSQIRALSGSTVGGEDILQNVMRHLMPDFDSLYAGQTMDRIKSIGLLRMATQDAIHKLATQEHVEINVDLGAGHKVSKILDRGEFEKVNQSIFEKCEGIIKQCLADAKLTPEDINDVILVGGCSRIPKIRSVVLGLCKKDDSYSGIDPLEAAVSGAALEGAIASGVSDPSGSLDLLTIQATPMNLGIRADGGNFAAIIPRNTAVPARRDMLFTTTHDNQTEALIAVYEGEGNQAEDNHLLGYFKITGIPAAAKGTVEINVCMDIDAGNVLRVFAGVVKPQGQAVPPFIEVRMPTLDDGHGWCGQALAKMYGSTLDLATIPKKLHP

SEQ ID NO: 181 - DNA, 480 bp, Oryza sativa
  CDS (1)..(480)
atggatgtacgccctttcatggagctgtctgttagcaaccttactgacttagtacaagcagtagcagtttctagtacaatggagggaaggagggagagagagctcgacaaggttcagccgaaccagatcgagccgccgccttctgtagttcccggctgggcttggcttggagagtggatgaatacgatctttttcatttggtttgcactgtcaggatggctattcagagttttcatttttggtacatttgtcctgccttttgctgcgccacttctccttgggacatttggtaatcgggtcgccattgaggggacatgcccagcgtgcaaacggaggtttgtgggttaccgcaaccaagtgattcggtgcatgaattgccaaaacatagtgtggcagccaaacaataggtcctctggacgagccagcagttcaagaagctcagggcctgatgttattgatgtggagtttgaggagaagtaa

SEQ ID NO: 182 - protein, 159 aa, Oryza sativa
MDVRPFMELSVSNLTDLVQAVAVSSTMEGRRERELDKVQPNQIEPPPSVVPGWAWLGEWMNTIFFIWFALSGWLFRVFIFGTFVLPFAAPLLLGTFGNRVAIEGTCPACKRRFVGYRNQVIRCMNCQNIVWQPNNRSSGRASSSRSSGPDVIDVEFEEK

SEQ ID NO: 183 - DNA, 3618 bp, Oryza sativa
  CDS (1)..(3618)
atggcccacggttcacaatgtggattttgcacccctggttttgtgatgtcgatgtatgcattgctgagatcaagtgaacagcctcctactgaagagcagattgaagatagccttgcaggaaatttatgtcgctgtactggctacagaccaataatagacgccttccgtgttttctcgaaaagagatgatcttttgtacaacaattcatctctgaaaaatgcagatggccgacctatctgcccttcaacaggaaaaccatgttcctgcggagatcagaaagacatcaatggtagtgaatcttcattattgacacctacgaaaagctactcaccttgttcatacaatgagattgatggaaatgcgtacagtgagaaagaactcattttccccccagaacttcagttgagaaaagttacgtcacttaaattgaatgggtttaatgggattcggtggtatagacctcttaaactaaagcaagtattgcatttgaaagcatgctacccaaatgcaaaactaatcattggtaactctgaagtaggagttgaaacaaagttcaagaatgcccagtataaggtcttgatctcagttactcatgttccagagcttcatacccttaaagtgaaagaggatggtatacatattggttcttctgtaagacttgcacagctccaaaatttcctcagaaaggttattttagagcgtgattcacatgaaatttcatcctgtgaggcaatactgcggcaattaaaatggtttgctgggacacaaatcaggaatgttgcttctgttggaggtaacatttgtactgctagtccaatatcagatctaaatccactttggatggctacaggtgcaacgtttgagataattgatgtgaacaataatattaggaccattcctgcaaaagatttttttctgggttatcgtaaagttgacttaaaacctgatgagatattgctctctgttatactgccatggacaaggccatttgaatttgtcaaagaattcaagcaggcacatagaagggaggatgacattgcgttggtgaatgctggaatgcgtgtctatataagaaaagttgaaggtgattggataatttcggatgtttcaattatctatggaggggtagctgcagtttcacaccgtgcttcaaaaactgaaacctttctcactggaaaaaaatgggactatggattgttggataagacttttgatctgttgaaagaagacgtagttctggctgaaaatgcacctggtggaatggatggattacatgcaaccaatctttcagccatacagtctttcactagacctgtcggtgttggaactcaatgttatgaattggttagacaaggaactgcagttggccaacctgtggttcacacatcagctatgcttcaggttactggtgaagcggaatatactgatgacacaccgacaccccccaataccttgcatgctgctctggtgctgagtacgaaagctcacgcacgcatattatctattgatgcttcacttgccaaatcttcccctgggtttgcgggtctcttcctttcaaaagacgtgcctggcgctaaccatactgggcctgttatccatgacgaggaggtttttgcatctgatgttgttacatgtgttggccagattgttggacttgttgtggcagatacccgtgataatgcaaaagctgctgcaaataaagtcaatattgagtattctgaacttccagcaattttatccatagaggaagctgtgaaagctgaaggaaaagtacaagttggaggtcaagagcacttctacatggagcctcagagcactcttgtatggccagttgattctggaaatgaaattcatatgatttcatctacccagaagcaccaaaagtatgttgctaatgttcttggtcttccacaatcaagagttgtttgcaagactaagcgtattggtggtggatttggtggaaaagaaaccagatcagcaatatttgctgcagcagcatctgtagctgcttattgtttaaggcagcctgtaaagcttgttttggacagggatattgacatgatgacaactggacagaggcacagtttcctagggaagtacaaggtgggatttaccgatgatgggaagatattggccttagaccttgatgtttataacaatggtggtcattcacatgatttgtcccttccagtcctggagcgtgctatgtttcattcagacaatgtctatgatataccaaatgtcagagtcaatgggcaagtatgtttcacaaatttcccaagcaatactgctttcagaggttttggtggtccacaagctatgctgattgcagagaattggattcagcacatggctacagaactcaagcgaagtcctgaggagataaaagaacttaattttcaaagtgagggatctgtgcttcattatggccagttgcttcaaaattgtacaatacattcagtatgggatgaactaaaggtttcttgtaattttatggaagctcgcaaagctgtaattgattttaacaataataaccgttggagaaagcgtggcattgctatggttcccaccaagtttgggatatccttcactacaaaattcatgaatcagttgcattgttattcattattcaatctaacggaggttctgatggatgaacaattgcaggctggtgctttagtgcaagtttacactgatggaactgtccttgtaacgcatggtggggttgaaatggggcagggtttacacacaaaggtagcccaagttgcggcttcatcattcaatatccctcttagctctatatttatctcagaaacaagcactgataaggtaccaaatgcaacaccaacagcagcctctgctagttcagatttatatggtgctgcagttttggatgcttgtcagcaaattatggctcggatggaacctgttgcttcaagaggaaaccacaagtcctttgctgagttggttctagcatgctacctggaaaggatagatctctctgctcatggattttatatcactcctgatgttgggtttgactgggtgtctggcaagggaactccattctactatttcacatacggagcagcatttgcagaagttgaaattgataccctaactggggatttccacacaaggacagtagatattgttatggatcttggctgttcaattaatccggctattgatattggccagattgaaggaggttttatccaaggattaggttgggcggccctggaagaactaaaatggggggatgataaccacaagtggattcgacctggacatcttttcacttgtgggcctggctcttacaaaataccctctgtaaatgatatacctctaaacttcaaggtctcacttttgaagggcgttttgaatccaaaggtcattcactcatccaaggctgtaggagagccaccgtttttcctcggttcagccgtcttgtttgccataaaggatgcgatatctgccgcaagagctgaggagggtcacttcgactggttcccactcgacagcccagcaacaccggaaagaataagaatggcatgcgtggattccatcacaaagaaatttgctagcgtatattaccgtcccaagcttagtgtatag

SEQ ID NO: 184 - protein, 1205 aa, Oryza sativa
MAHGSQCGFCTPGFVMSMYALLRSSEQPPTEEQIEDSLAGNLCRCTGYRPIIDAFRVFSKRDDLLYNNSSLKNADGRPICPSTGKPCSCGDQKDINGSESSLLTPTKSYSPCSYNEIDGNAYSEKELIFPPELQLRKVTSLKLNGFNGIRWYRPLKLKQVLHLKACYPNAKLIIGNSEVGVETKFKNAQYKVLISVTHVPELHTLKVKEDGIHIGSSVRLAQLQNFLRKVILERDSHEISSCEAILRQLKWFAGTQIRNVASVGGNICTASPISDLNPLWMATGATFEIIDVNNNIRTIPAKDFFLGYRKVDLKPDEILLSVILPWTRPFEFVKEFKQAHRREDDIALVNAGMRVYIRKVEGDWIISDVSIIYGGVAAVSHRASKTETFLTGKKWDYGLLDKTFDLLKEDVVLAENAPGGMDGLHATNLSAIQSFTRPVGVGTQCYELVRQGTAVGQPVVHTSAMLQVTGEAEYTDDTPTPPNTLHAALVLSTKAHARILSIDASLAKSSPGFAGLFLSKDVPGANHTGPVIHDEEVFASDVVTCVGQIVGLVVADTRDNAKAAANKVNIEYSELPAILSIEEAVKAEGKVQVGGQEHFYMEPQSTLVWPVDSGNEIHMISSTQKHQKYVANVLGLPQSRVVCKTKRIGGGFGGKETRSAIFAAAASVAAYCLRQPVKLVLDRDIDMMTTGQRHSFLGKYKVGFTDDGKILALDLDVYNNGGHSHDLSLPVLERAMFHSDNVYDIPNVRVNGQVCFTNFPSNTAFRGFGGPQAMLIAENWIQHMATELKRSPEEIKELNFQSEGSVLHYGQLLQNCTIHSVWDELKVSCNFMEARKAVIDFNNNNRWRKRGIAMVPTKFGISFTTKFMNQLHCYSLFNLTEVLMDEQLQAGALVQVYTDGTVLVTHGGVEMGQGLHTKVAQVAASSFNIPLSSIFISETSTDKVPNATPTAASASSDLYGAAVLDACQQIMARMEPVASRGNHKSFAELVLACYLERIDLSAHGFYITPDVGFDWVSGKGTPFYYFTYGAAFAEVEIDTLTGDFHTRTVDIVMDLGCSINPAIDIGQIEGGFIQGLGWAALEELKWGDDNHKWIRPGHLFTCGPGSYKIPSVNDIPLNFKVSLLKGVLNPKVIHSSKAVGEPPFFLGSAVLFAIKDAISAARAEEGHFDWFPLDSPATPERIRMACVDSITKKFASVYYRPKLSV

SEQ ID NO: 185 - DNA, 2253 bp, Oryza sativa
  CDS (1)..(2253)
atggcgggggcgatccgcgtcaccatggaggtgggcgccgacggcgtcgcggtcgtcaccatctgcaacccgcccgtcaatgcgctgcatcccatcagtaggcctcctctcatccagggattgaaggagaagtacgcggaggcgatggatcgcgacgacgtcaaggccatcgtgctcaccgatgtgtatggtttaactggatcaagctatctttggtctgttgttctgagtggttgtggagtagtccctatcctatcatttgagctgatcttggtcaactgggttaatgagtgtgctgctccagctgtacaagatttgctttcctggtggtctggaactctagtggagctgctgaactgtgctggaggcaaattttgtggaggctttgatatcaatgtgttcacagaagttcacaagactggaaatgtatctcttatgcctgatgtatctgttgagcttgtgtcgaatttgatggaagcgggcaaaaagccttcagttgctgccattcaaggccttgctcttggtggcggtttggagttgaccatgggttgccatgctcggatatctacccctgaagctcaacttggactaccagagttgactctgggcataattcctggatttggaggaacccagcgtctgccaaggcttgtaggtctgcccaaagcaatagaaatgatgctgcaatcaaagttcatcacagcaaaggaagggaaagaaggtggtcttgttgatgccctgtgctcccctgatgagttgataaagatgtcacgcctttgggctctggagatagctaattaccgtaaaccttggataagatctcttgccagaacagataggcttggttcactgtctgaagctcgttctgtattaaatagtgcaagacagcaagcgaagaaggttgcagcaaacttgccacagcaccaggcctgcctagatgttatggaagaaggtgtactatgtggaggccatgctggtgttctgaaggaggccaaggttttcaaggagttggtgctatcaccaacatcaaaggcacttgtacatgctttctttgcccagcgtttaaccacaaaggtgccaggtgttactgatgttcaattgaaacctaggaaaataagaaaagttgctgttattggtggtggtttgatgggctctggaattgcaacagctcttcttgttagcaatacatccgttgtgcttaaggaagtaaatcctcaattcctgcaaaggggacagaagatgatagcagctaatcttgagggtctagtcaagaggggctcattgacaaaggacaagatgaacaaggccatgtcacttctcaagggtgcattggattattctgatttcaaggatgttgatatggtcatcgaggctgtcatagagaagattcctttgaaacaatcaatattttctgaccttgagaaatgggaactcctcagtgttgacatacaaagttacaaaccctgcgtgaaagttctctatcgtactcttgtttttggagcgggtgttgagttgttgattgttgtttatggcacttttatctgcaaaagcatggctaatcatgatatcatgcgaaacccagtagatataacagaatatagccctgcccatattatgcctttgcttgaaattgtccggacggagaagacatcaccgcaagctattcttgatctcatcacagttgggaaaatgataaagaaagtccctgttgtggttgggaactgcacaggcttcgcagtcaatcgtacatttttcccttacacacagggttctcatcttctagttagtattgggatcgacgttttcagaattgatcgagtaataagcagctttggcatgccaatgggaccttttcaactgcaagatctggctggatatggagtggcattggcagtaaaggatatctatgcggctgcctttggaacaaggaatctggactctaatctggtggatttgatggtacagaatggacggcagggaaagagcaatggtaaaggttattacctttatgagaagggtgggaagccgaagcctgacccaagtgttcaggttgtgattgacgagtacagaagatgtgcaaagacaatgcctggtggaaagcctgttactttatctgatcaagatatattggagatgattttcttcccagttgttaatgaggcatgcagggtcatggatgaaaatgttgtgatccgagcttctgatcttgatattgcttctatccttgggatgggttttcccaagttcaggtaa

SEQ ID NO: 186 - protein, 750 aa, Oryza sativa
MAGAIRVTMEVGADGVAVVTICNPPVNALHPISRPPLIQGLKEKYAEAMDRDDVKAIVLTDVYGLTGSSYLWSVVLSGCGVVPILSFELILVNWVNECAAPAVQDLLSWWSGTLVELLNCAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKWELLSVDIQSYKPCVKVLYRTLVFGAGVELLIVVYGTFICKSMANHDIMRNPVDITEYSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFR

SEQ ID NO: 187 - DNA, 1860 bp, Oryza sativa
  CDS (1)..(1860)
atggagaaggtacgggcggcggggctgctccggacgcaggggctcatcggcggcaaatgggtggacgcctacgacggcaagaccatcgaggttgtgaacatgcaatttgctcttggaaatccctgtgagcagttcgttgagctaatttattttctgcaagatgctttgtacctggtggttcaaaatccagcaactggagagactcttgccaatgtgtcctgtatgggcagcaaagaaacatctgatgcaatagcttcagctcacagtacattctattcttggagcaaactcactgcaaatgagaggagcaaggctctaagaaaatggcatgatttaattatctcacacaaggaagaacttgcacttctcatgacactggagcaagggaaacctatgaaagaggctcttgttgaggtcacatatggtgcaagttttattgaatactttgctgaagaagcaaagcgtatatatggtgatattattcccccaactctatctgatcgtagattattggttttgaagcagcctgttggagtagttggagctgttacaccatggaattttcctttagcgatgataaccagaaaggttggaccagcattggcttgtggctgcactgtcgttgtcaagccatcagagttcacacctttgacagcacttgctgcagcagatcttgctcttcaagctggaataccagctggcgcaataaatgttgtgatgggtaatgctcctgagataggtgatgctctactccagagtacacaggttctatttcctcccattcttcatcatatccgcaatattagattcttccgagttaataggataagtcagaaagattacattcacagggtcaacagctgttggcaaaaaactgatggctggatcagcaaatactgtgaagaagatgtgctgaaagcatcaaatcttggaaaagcagccccaaatttgccatttggcagaagctggtggaaatgcctgcattttggaacccctgatgctttgacatttctgcttttgacctttttggtggcatattggtcgcagttgcaccatattgtttctttggagcttggtggcaatgcaccttgcattgtttttgatgatgcagacattgatgttgccattaaaggcagtcttgctgctaagttccgtaacagcggacagacatgtgtatgtgcaaacaggatattggtgcaagaaggtatttatgaaaaatttgcaagtgcgtttatcaaggctgttcagagtttgaaggttggtaatgggcttgaagagagtacatcacagggccctctgatcaatgaagctgctgttcagaaggtagagaagttcataaatgacgccacttcaaagggagcaaacatcatgcttggtggtaaaaggcacagccttgggatgtcattctatgagccaactgtagtagggaacgtcagcaatgatatgcttcttttcagggaagaagtctttggtccagttgcaccacttgtaccattcaaaactgaggaagatgcaatccgtatggccaatgataccaacgcaggcttagctgcatatatcttcacaaagagcatacctcgttcatggcgcgtttcggaagctcttgaatatggactagtcggtgtgaacgaggggatcattctcaacagaggttgcgccgtttggcggcgtcaagcaatctggccttgggagagaaggatcaaaatacggcatggacgagtacctggagctcaagtacatttgcatgggaaacctgaactgatccacttgagagtaccgtgcgtcttaaaaccgaagtacctggctggtgatgaatcgaagccgggggcaagagtagctgcaagaactgaagagcactga

SEQ ID NO: 188 - protein, 619 aa, Oryza sativa
MEKVRAAGLLRTQGLIGGKWVDAYDGKTIEVVNMQFALGNPCEQFVELIYFLQDALYLVVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVLFPPILHHIRNIRFFRVNRISQKDYIHRVNSCWQKTDGWISKYCEEDVLKASNLGKAAPNLPFGRSWWKCLHFGTPDALTFLLLTFLVAYWSQLHHIVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIILNRGCAVWRRQAIWPWERRIKIRHGRVPGAQVHLHGKPELIHLRVPCVLKPKYLAGDESKPGARVAARTEEH

SEQ ID NO: 189 - DNA, 3897 bp, Oryza sativa
  CDS (1)..(3897)
atgacgatattcccgctcccacaatcgcgttggccgattggccccgtctccaagaaagaaaagaaaaaaacatcagagagagagaagaagcttcatcttcgctgtccaccgcagcggcggcggctttgcataacccgtgcaacccgcgaggccgccaacccccatctcgtctcggcaaccctactcgcgcttgcccaccacgcgtctctcccaaaattcgcggcctcctatataacgccgtctcgatctctctctctcctcctcctccgcttcgcagaccagccagccatgcctcccctcacgagcgccctcctctcccgctcctcctctacccgcatccccgccgcggcggcggcggcggcggcgatctcgaatcccgcgggcgccgccgcgtcgtcgtcgtcgccgtcaccgccgcctccgagctctcgccccaggccggcgtccccctttgcgtccggcctcgctggccgcatcttcggcggccgccgcgccgccgcgcgctcctcgtcgtccgccgcggccgtcttcgagcggcgcttcgcctcggcggcggcgaagaactcgtacgatgaaatcctgacgggcctcgcgaagccgggaggcggagcggagttcgggaaatactacagcctgcccgcgctatccgatccgcggatcgagcgactcccttactcgataaggattcttctcgagtcggcaatcagaaactgtgatgagttccaggtcaccgggaaggacgttgagaaaatcctggactgggagaacagcgcaccaaagcaagtcgaaatcccatttaagccagcccgtgtcctcctccaggatttcactggtgttccagcagtggttgatcttgcgtgcatgagggatgctatgagcaaacttggcagtgacccaaacaaaattaatcctctggtacctgtagatcttgttattgatcattcagtacaagttgatgtggcaagatcagaaaatgctgttcaggcaaatatggagctagagttccatcgtaacaaggagaggtttggatttttgaaatggggttcaactgctttccgtaacatgcttgttgttccacctggatctggaattgtgcatcaggttaaccttgaatatctggccagagttgtgtttaacaatggtgggatcctttaccctgatagtgttgttggaacagactcccacacaactatgatagatggtcttggtgttgctggatggggagttggtggtatagaggcagaagctacaatgcttggccagccaatgagcatggtattgccaggagttgtgggcttcaagttaacagggaagctgaggaacggtgttactgctacagatttggttctaacagtaactcaaatgcttaggaaacatggcgttgtcggaaaatttgttgaattttacgggggaggcatgagtgaattatcactggctgatagggctacaattgcaaacatgtcaccagaatatggtgcaactatgggtttcttcccagttgatggaaagacattggactacttgaagctaactggcagaagtgatgacactgtggccatgatagagtcttacctgcgtgccaataagatgttcgtcgactacaaccagcctgaagctgaaagagtgtactcatcttatctggaacttaacttggaggaggtagagccatgcttgtctggaccaaaacgttataaactgaagaacccactgcacaggcctcatgaccgagtgactttgaagaacatgaaatcagattggctgtcttgcttggataatgatgtaggcttcaagggttttgctgtccccaaagaatcacagggtaaagttgctgagttctctttccatgggacaccagcaaagctaaagcatggtgatgttgtaattgctgctataaccagttgcaccaacacatcaaatcctaatgtaatgctgggagctgctttagttgccaaaaaggcttgtgaattaggccttgaggtcaagccatggattaagacaagtcttgcacctggttctggagttgtgaagaagtacttggacaagagtggtctgcagaaatatctagaccagcttggcttccatattgtaggctatggttgcacaacctgcataggaaattctggagaacttgatgaaacagtatctgctgcaatttctgacaacgatattgtcgctgctgccgtgttatctggaaacagaaattttgaagggcgtgtgcacgcattaaccagagcaaattatcttgcctctcctccattggttgtggcctatgcccttgctggcacggtcaatattgattttgagaaagaaccaattggcatctcgaaagatgggaaggaggtttacttcagggacatctggccttccactgaagagattgctgaggttgttaaatcaagtgtgctacctgacatgtttaagagcacatacgaggcaataaccaaaggaaatcctatgtggaatgagctgtctgtatcagcaagcactctctacccatgggacccgacatctacttacatccatgagcctccttatttcaaggatatgacaatgtcccctcctggcccacggcctgtgaaggatgcttactgtctcctgaactttggtgacagtatcacaactgatcacatctcacctgccggaagtattcaccctgacagccctgctgctagatatctgaaggagcgtggtgttgaaaggaaggacttcaactcatatggcagtcggcgaggaaatgatgagatcatggctaggggaacttttgccaacattcgccttgtgaacaagttcttgaagggtgaggttggcccaaaaaccatccatattccatcaggggagaagctctctgttttcgacgctgctacgaaatacaagaatgaaggacatgacactattatcctggctggtgctgagtacggtagtggaagctctcgggattgggctgcgaagggtccaatgctacagggagtcaaggctgtgattgctaagagctttgaaaggattcaccgcagcaaccttgctggtatgggtatcattcctctatgcttcaagtcaggggaggacgccgacacccttggattgactggccatgagcgtttcacggttcacctcccggccaatgtaagtgagatcaagcctgggcaagatgttactgtgacgactgataatgggaagtccttcacttgcacacttcgatttgacactgaggtggagcttgcatactacgacaatggtggcattttaccgtatgtcatcagaaagatcgccgagcatatgactgccacagtaatgctggcgttgcgtaacgtaacgaggaatttcggacacatggaggagatggtgttggccttctcctccccttcgcacgcgctctctggcagccgaccttgccgcgcgctgagtcgccacgcgtcggtctcaggatcgatcgcgcgtgcccgaccgccttggcgcgccgtcgcccgtccgacgccctcagcccaccgctgccgtaccaatctcgacgacgacaaagccgggacgacgaccgccgcacgaaatcaccgctcgacgccgtgcgcacccgtccaagccgccaccgagtgcgatttcgcttctacccggggtgaatcgcgccaattcttgccgcacggttggattggagatagacggtggtatcccctctcacaattcaaaccattcacccccgagccggccgttttcaccctcgccgccgccgcgcgttgcgctcggattggcgccaacacgtcaccagccgattccaaccgcggtcaagtcaatccttcaccggtaagtattcgaacgtggcctcccgccactcaaatcgatcttgcccgccctctctcagcctctgccacctttgcctcatccaaatcccgagctcatccatggcgatga

SEQ ID NO: 190 - protein, 1298 aa, Oryza sativa
MTIFPLPQSRWPIGPVSKKEKKKTSEREKKLHLRCPPQRRRLCITRATREAANPHLVSATLLALAHHASLPKFAASYITPSRSLSLLLLRFADQPAMPPLTSALLSRSSSTRIPAAAAAAAAISNPAGAAASSSSPSPPPPSSRPRPASPFASGLAGRIFGGRRAAARSSSSAAAVFERRFASAAAKNSYDEILTGLAKPGGGAEFGKYYSLPALSDPRIERLPYSIRILLESAIRNCDEFQVTGKDVEKILDWENSAPKQVEIPFKPARVLLQDFTGVPAVVDLACMRDAMSKLGSDPNKINPLVPVDLVIDHSVQVDVARSENAVQANMELEFHRNKERFGFLKWGSTAFRNMLVVPPGSGIVHQVNLEYLARVVFNNGGILYPDSVVGTDSHTTMIDGLGVAGWGVGGIEAEATMLGQPMSMVLPGVVGFKLTGKLRNGVTATDLVLTVTQMLRKHGVVGKFVEFYGGGMSELSLADRATIANMSPEYGATMGFFPVDGKTLDYLKLTGRSDDTVAMIESYLRANKMFVDYNQPEAERVYSSYLELNLEEVEPCLSGPKRYKLKNPLHRPHDRVTLKNMKSDWLSCLDNDVGFKGFAVPKESQGKVAEFSFHGTPAKLKHGDVVIAAITSCTNTSNPNVMLGAALVAKKACELGLEVKPWIKTSLAPGSGVVKKYLDKSGLQKYLDQLGFHIVGYGCTTCIGNSGELDETVSAAISDNDIVAAAVLSGNRNFEGRVHALTRANYLASPPLVVAYALAGTVNIDFEKEPIGISKDGKEVYFRDIWPSTEEIAEVVKSSVLPDMFKSTYEAITKGNPMWNELSVSASTLYPWDPTSTYIHEPPYFKDMTMSPPGPRPVKDAYCLLNFGDSITTDHISPAGSIHPDSPAARYLKERGVERKDFNSYGSRRGNDEIMARGTFANIRLVNKFLKGEVGPKTIHIPSGEKLSVFDAATKYKNEGHDTIILAGAEYGSGSSRDWAAKGPMLQGVKAVIAKSFERIHRSNLAGMGIIPLCFKSGEDADTLGLTGHERFTVHLPANVSEIKPGQDVTVTTDNGKSFTCTLRFDTEVELAYYDNGGILPYVIRKIAEHMTATVMLALRNVTRNFGHMEEMVLAFSSPSHALSGSRPCRALSRHASVSGSIARARPPWRAVARPTPSAHRCRTNLDDDKAGTTTAARNHRSTPCAPVQAATECDFASTRGESRQFLPHGWIGDRRWYPLSQFKPFTPEPAVFTLAAAARCARIGANTSPADSNRGQVNPSPVSIRTWPPATQIDLARPLSASATFASSKSRAHPWR

SEQ ID NO: 191 - DNA, 2412 bp, Oryza sativa
  CDS (1)..(2412)
atgtcgggccccaagctcgaccgcaccccgagcatccgcgaccgcgtcgaggacaccctccacgcccaccgcaacgagctcgtcgccctcctctccaagtacgtgagccaggggaaggggatcctgcagccgcaccacatcctcgacgcgctcgacgaggtccagagctccggcggccgcgccctcgtcgagggccccttcctcgacgtcctccgctccgcccaggaggcgatcgtgctgccgccgttcgtggcgatcgcggtgcggccgcggccaggggtgtgggagtacgtccgcgtgaacgtgcacgagctcagcgtcgagcagctcaccgtgtcggagtacctccgcttcaaggaggagctcgtcgacggccagtacaacgatccgtacatacttgagcttgattttgagccattcaatgcctcggttccacgcccaaatcggtcatcatcaattggaaatggcgtgcagtttctcaacaggcacttgtcttcgatcatgttccggaacaaggattgcctggagcccctacttgatttccttcgtgggcatcggcataagggtcatgatacagagtctgggaagacttcaagtctgtgcttgacaaaagctgaggagcacttgtcgaaactcccagctgacacaccatactcacagttcgcatataagtttcaagaatggggattggagaagggttggggcgacacagctggatatgtcttggagatgatacatctccttctggatgtgcttcaagcgcctgatccatctactcttgagacgttcttgggaaggatccccatgatctttaatgtcgtcgtagtgtctcctcatggatattttggccaagccaatgtgttgggcttaccagatactggagggcagattgtctatatactggaccaagtccgtgcattggagaatgagatggttcttaggttaaagaaacaaggccttgattttacccctaaaattcttattgttactcggctgataccagaagcaaaagggacatcatgcaatcagcgtcttgagagaataagtgggacacaacatacttacatattacgagtgccattcagaaatgaaaatgggatactcaggaaatggatatcaagatttgatgtatggccctacctggagaaatttgcagaggatgctgctggtgagattgctgcagaactacaaggtactccagacttcataattggaaactacagtgacggtaatcttgttgcatcattgctatcttacaagatgggaattacccagtgcaatattgctcatgctttggaaaagactaaatatccagactcagacatatactggacgaagtacgatgagaagtaccatttctcctgtcagttcacagctgatataatcgccatgaacaatgctgattttataatcaccagcacataccaggaaattgctggcagcaaaaacacagttggacagtatgagagccatactgcatttactcttcctggtctgtatcgtattgtccatgggattgatgtttttgacccaaagttcaacatagtctctccaggagcagacatgtctatatactttccgtacactgaaaaggccaagcggctcacttcgcttcatggttcacttgaaaacttgatttctgacccagagcaaaatgacgaacatattggacacctggatgacagatcaaaacccattctcttttccatggcaagacttgaccgagttaagaacataacagggttggttgaagcttatgctaaaaacgctaggctgagggagctggtaaaccttgtcgtggttgctggctataacgatgtcaagaaatccaaggacagagaagaaatcgcagagattgagaagatgcatgaacttattaagacctataacttgtttgggcagttccgttggatctcggctcagacgaacagggctcgcaatggtgagctctatcgctacatagctgatactcatggtgccttcgtgcagccagctttctacgaagcattcggtctcactgttgtggaggccatgacatgtggactccctacttttgcaacagtccatggtggacctgccgagattatagagcacgggatctcagggttccacatagatccttatcatccggatcaagctgcaaatctgatagctgacttcttcgaacaatgtaaacaagaccccaaccattgggttgaagtttctaatagaggcctacaacgtatatatgagaaatatacatggaagatctactctgagaggttgatgacattggctggggtttatggcttctggaagtatgtctcgaagcttgagaggcgggagaccaggcgctatcttgagatgttctacatattgaagttccgtgaactgccaagactgtaccctcttgcagtagatgaggcacactga

SEQ ID NO: 192 - protein, 803 aa, Oryza sativa
MSGPKLDRTPSIRDRVEDTLHAHRNELVALLSKYVSQGKGILQPHHILDALDEVQSSGGRALVEGPFLDVLRSAQEAIVLPPFVAIAVRPRPGVWEYVRVNVHELSVEQLTVSEYLRFKEELVDGQYNDPYILELDFEPFNASVPRPNRSSSIGNGVQFLNRHLSSIMFRNKDCLEPLLDFLRGHRHKGHDTESGKTSSLCLTKAEEHLSKLPADTPYSQFAYKFQEWGLEKGWGDTAGYVLEMIHLLLDVLQAPDPSTLETFLGRIPMIFNVVVVSPHGYFGQANVLGLPDTGGQIVYILDQVRALENEMVLRLKKQGLDFTPKILIVTRLIPEAKGTSCNQRLERISGTQHTYILRVPFRNENGILRKWISRFDVWPYLEKFAEDAAGEIAAELQGTPDFIIGNYSDGNLVASLLSYKMGITQCNIAHALEKTKYPDSDIYWTKYDEKYHFSCQFTADIIAMNNADFIITSTYQEIAGSKNTVGQYESHTAFTLPGLYRIVHGIDVFDPKFNIVSPGADMSIYFPYTEKAKRLTSLHGSLENLISDPEQNDEHIGHLDDRSKPILFSMARLDRVKNITGLVEAYAKNARLRELVNLVVVAGYNDVKKSKDREEIAEIEKMHELIKTYNLFGQFRWISAQTNRARNGELYRYIADTHGAFVQPAFYEAFGLTVVEAMTCGLPTFATVHGGPAEIIEHGISGFHIDPYHPDQAANLIADFFEQCKQDPNHWVEVSNRGLQRIYEKYTWKIYSERLMTLAGVYGFWKYVSKLERRETRRYLEMFYILKFRELPRLYPLAVDEAH

SEQ ID NO: 193 - DNA, 1746 bp, Oryza sativa
  CDS (1)..(1746)
atggcggcggccacctccacttcctccaccgcgctcgcccaccccaaaaccctaaaccccgcctccaaatccgcggccgccggctcggtctccttccccgccgcccagcccccatgccccctcgccgcctccgccggcggccgccgccgccgcggcgccgtggccgccaaggtctcgtcgccgcaggtgatcggggccaccatgccgtcgctggacttcgagacatccgtcttcaagaaggagaaggtgtctctagctggccatgacgagtatattgtgaggggcgggaggaatctgttcccgctgctgccggaggcgttcaaggggatcaagcagatcggcgtaatcggatggggttctcagggtcctgcacaagctcagaacctgagggactcacttgctgaggcaaaatcagacatcgttgttaagattggtctccggaaaggttctaaatcttttgaagaagcacgcgcagctggatttactgaagagagtgggacacttggagatatatgggagactatctcaagtagcgatcttttgttgttgttgatatcagatgctgctcaggcggataactatgaggaaattttctcacacatgaaacccaacagtattcttggattgtcacatggatttctccttggacatttgcaatctgttggccttgatttccctaaaaacatcagtgttgttgctgtgtgtcccaagggaatgggcccatcagttagaaggctttatgttcagggaaaagaagtaaacggtgctggtatcaactccagctttgctgtacaccaggatgttgatggaagagcaacagatgtcgctcttggatggtcagttgctctaggttctcctttcacatttgctactactctagagcaggagtaccgaagcgatatttttggcgagcgaggtattttgcttggggctgtacatggtattgtggaggctcttttcaggagatacacagagcatgggttggatgaggactcagcatacaagaacactgttgagtgcatcactggaatcatctctaaaactatttcgaaaaaggggatgcttgaagtgtacaattcattgacagaagaaggaaagaagcaatttatcgaggcttacagtgcagcatattatccatgcatggatatactatatgaatgctatgaagatgtttcttctggaagtgaaattagaagtgttgttttggctggaaggagattttatgaaaaggaaggacttcctgctttcccgatgggcaacattgatcaaacacgtatgtggaaggtgggtgaaagggtgcggtcaacacggccagcaggtgatcttggcccattacatcctttcactgctggagtgtatgttgcacttatgatggcacagattgaagtccttagaaagaagggccactcttactcggagatcatcaacgagagtttgatcgagtctgtggattccctgaacccattcatgcacgctcgtggggtggccttcatggttgataactgctccacaacagcccggttgggatcaaggaaatgggcgccacgcttcgactacatcttgacccaacaagcttttgtgactgttgacaagaatgctccagttaatcaagacctcatcagcaatttcttctccgatcccgtccatagtgccattgaagtctgtgctcagttgaggcccaccgttgacatttcagtgcctgctgatgcagactttgtgcgtccagagctgcgacaatcttcgtga

SEQ ID NO: 194 - protein, 581 aa, Oryza sativa
MAAATSTSSTALAHPKTLNPASKSAAAGSVSFPAAQPPCPLAASAGGRRRRGAVAAKVSSPQVIGATMPSLDFETSVFKKEKVSLAGHDEYIVRGGRNLFPLLPEAFKGIKQIGVIGWGSQGPAQAQNLRDSLAEAKSDIVVKIGLRKGSKSFEEARAAGFTEESGTLGDIWETISSSDLLLLLISDAAQADNYEEIFSHMKPNSILGLSHGFLLGHLQSVGLDFPKNISVVAVCPKGMGPSVRRLYVQGKEVNGAGINSSFAVHQDVDGRATDVALGWSVALGSPFTFATTLEQEYRSDIFGERGILLGAVHGIVEALFRRYTEHGLDEDSAYKNTVECITGIISKTISKKGMLEVYNSLTEEGKKQFIEAYSAAYYPCMDILYECYEDVSSGSEIRSVVLAGRRFYEKEGLPAFPMGNIDQTRMWKVGERVRSTRPAGDLGPLHPFTAGVYVALMMAQIEVLRKKGHSYSEIINESLIESVDSLNPFMHARGVAFMVDNCSTTARLGSRKWAPRFDYILTQQAFVTVDKNAPVNQDLISNFFSDPVHSAIEVCAQLRPTVDISVPADADFVRPELRQSS

SEQ ID NO: 195 - DNA, 1629 bp, Oryza sativa
  CDS (1)..(1629)
atgccgagcgaaagcgcgctcacctcacggaggaagaggacgaggcctcgccagagagggagtcccgccgccgccgccgtggagggttttgagaggagaggagaggagagcacgggagccgtgcggatttgggaggaaagagagagagagagtgtgtggcttggttgcctcctcggtgggcctcactccccaccgtgcgcggccgcgggccccaccgaagaaacaccacactcccgtgactcgtgtcgtcgtcttcctcgtcagccgccactgccgtcgcgtcgtctccaacctcctcgccttcgcctccacccagccatggcgacgagcgccgccgcgcgcttcctcgctgccctcgcgggcgccgccgtcctcctcgtcctgctcggcggagctgctggcgcggtggtggggcacgacgacgacgcggcggcggcgcggcggacgatggaggagttcgccggattccccgcgtccgactaccgcggcgatggcggtggcggcagcggcggctcctccccgttctacgtcgactccgatgggctccagcgccagattgatgagctggcttcgttctccgactcgccggtgccgtcggtgacccgcgttctgtacagcgacaaggacgtgcaagctcgaaggtatataaagggaataatgaatcagcttggcctgtccattcgtgaagacgctgttggcaacatttttgggcgctgggagggttctgaggcaggactaggagcggttgcaactggttctcatgttgacgcaatcccattctcaggcaaatatgatggggtggttggtgtcctgggtgctcttgaggcaattagaatgctgaaaaggtgtaaatactacctaaaagtctggtttccagccaaaaagatctttggagactctgctggctacaagatgcatcctgaggagctacataatgtgtttttgaagaaagacgactattttgcttttgtagaattgcacattgaacagggccccattttggaaaaagaaggtatcaaaattggcgttgtcactgctattgctgctcctgcaagtattaaggtggagtttgaagggaatgggggccatgctggagcagtgctcatgcctgcaaggtccccaccacatatttacatgggtaaagaaactttttacagaaatgatgctggactggcggcagctgagttggcattagcagttgagaaacacgttttggaatcaggatcaattgatactgttgggacagttgatgtgagagacattgatgagaagaggaggaataatgtcattgagaaggttcaccaatccgcaattgagatatcaaagaaccgtggcgtgctattatcagagttcaagatcataaatcaggatccacctgctctatctgacaaatcagtcatcagcgcaatggaatttgctgcaaaacagttgaacctcgaatataagctgatgattagcagagcttatcatgattcactcttcatggccagaatatcaccaatgggtatgatcttcattccatgttacaaaggttacagccacaagcccgaagaatatgcgtcaccagaggacatggcgaacggtgtgaaggtgcttgccttggcaatggccagattatccctgcagtga

SEQ ID NO: 196 - protein, 542 aa, Oryza sativa
MPSESALTSRRKRTRPRQRGSPAAAAVEGFERRGEESTGAVRIWEERERESVWLGCLLGGPHSPPCAAAGPTEETPHSRDSCRRLPRQPPLPSRRLQPPRLRLHPAMATSAAARFLAALAGAAVLLVLLGGAAGAVVGHDDDAAAARRTMEEFAGFPASDYRGDGGGGSGGSSPFYVDSDGLQRQIDELASFSDSPVPSVTRVLYSDKDVQARRYIKGIMNQLGLSIREDAVGNIFGRWEGSEAGLGAVATGSHVDAIPFSGKYDGVVGVLGALEAIRMLKRCKYYLKVWFPAKKIFGDSAGYKMHPEELHNVFLKKDDYFAFVELHIEQGPILEKEGIKIGVVTAIAAPASIKVEFEGNGGHAGAVLMPARSPPHIYMGKETFYRNDAGLAAAELALAVEKHVLESGSIDTVGTVDVRDIDEKRRNNVIEKVHQSAIEISKNRGVLLSEFKIINQDPPALSDKSVISAMEFAAKQLNLEYKLMISRAYHDSLFMARISPMGMIFIPCYKGYSHKPEEYASPEDMANGVKVLALAMARLSLQ

SEQ ID NO: 197 - protein, 14 aa, Paramyxovirus SV5
GKPIPNPLLGLDST

SEQ ID NO: 198 - protein, 5 aa, Artificial
  Artifical epitope tag
FHHTT

What is claimed is:

1. A transgenic plant comprising an isolated nucleic acid molecule comprising a nucleotide sequence, the nucleotide sequence selected from the group consisting of:
   (a) the nucleotide sequence of SEQ ID NO: 51;
   (b) a nucleotide sequence that is at least 95% identical to (a);
   (c) a nucleotide sequence fully complementary to (a) or (b); and
   (d) a nucleotide sequence which is the reverse complement of (a) or (b),
wherein the nucleotide sequence encodes the polypeptide of SEQ ID NO. 52, wherein the transgenic plant has enhanced drought resistance compared to a non-transgenic plant.

2. The transgenic plant of claim 1, wherein the plant is a monocot.

3. The transgenic plant of claim 2, wherein the monocot is selected from the group consisting of rice, maize, wheat, barley, oats, rye, millet, sorghum, triticale, secale, einkorn, spelt, emmer, teff, milo, flax, gramma grass, *Tripsacum,* and *teosinte.*

4. The transgenic plant of claim 1, wherein the plant is selected from the group consisting of rice, wheat, barley, rye, corn, potato, canola, soybean, sunflower, carrot, sweet potato, sugarbeet, bean, pea, chicory, lettuce, cabbage, cauliflower, broccoli, turnip, radish, spinach, asparagus, onion, garlic, eggplant, pepper, celery, squash, pumpkin, cucumber, apple, pear, quince, melon, plum, cherry, peach, nectarine, apricot, strawberry, grape, raspberry, blackberry, pineapple, avocado, papaya, mango, banana, soybean, tobacco, tomato, sorghum and sugarcane.

5. The transgenic plant of claim 4, wherein the plant is rice.

6. The transgenic plant of claim 1, wherein the isolated nucleic acid molecule is expressed in a tissue selected from the group consisting of the epidermis, root, vascular tissue, meristem, cambium, cortex, pith, leaf, flower, and combinations thereof.

7. Transgenic progeny and seed from the transgenic plant of claim 1.

8. A transgenic plant comprising an isolated nucleic acid molecule comprising a nucleotide sequence, its full complement, or its full reverse complement, the nucleotide sequence encoding a polypeptide selected from the group consisting of:
   (a) a polypeptide having the amino acid sequence of SEQ ID NO. 52;
   (b) a polypeptide having an amino acid sequence that is at least 95% identical to and having a function as a polypeptide having the amino acid sequence of SEQ ID NO. 52; and
   (c) a polypeptide having an amino acid sequence encoded by a nucleotide sequence and having a function as a polypeptide having the amino acid sequence of SEQ ID NO. 52, wherein the nucleotide sequence is at least 95% identical to the nucleotide sequence of SEQ ID NO. 51, or a sequence fully complementary thereto,
wherein the transgenic plant has enhanced drought resistance compared to a non-transgenic plant.

9. Transgenic progeny and seed from the transgenic plant of claim 8.

10. A transgenic plant comprising the isolated nucleic acid molecule of SEQ ID NO: 51, wherein the transgenic plant has enhanced drought resistance compared to a non-transgenic plant.

11. A transgenic plant comprising an isolated nucleic acid molecule encoding a polypeptide having the amino acid sequence of SEQ ID NO. 52, wherein the transgenic plant has enhanced drought resistance compared to a non-transgenic plant.

* * * * *

UNITED STATES PATENT AND TRADEMARK OFFICE
CERTIFICATE OF CORRECTION

PATENT NO. : 7,732,667 B2  Page 1 of 1
APPLICATION NO. : 10/928992
DATED : June 8, 2010
INVENTOR(S) : Nguyen et al.

It is certified that error appears in the above-identified patent and that said Letters Patent is hereby corrected as shown below:

On title page, item (73), should read:

--Assignees: Syngenta Participations AG, Basel, Switzerland
The Texas Tech University System, Lubbock, Texas
The University of Missouri System, Columbia, Missouri--

Signed and Sealed this

Seventh Day of September, 2010

David J. Kappos
*Director of the United States Patent and Trademark Office*